United States Patent 7,314,750 (ADDRESSABLE OLIGONUCLEOTIDE ARRAY OF THE RAT GENOME) - sequence listing, part 19

SEQ ID NO: 679078 - DNA, 25 bp, Rattus norvegicus
ttgcctcttgtagatccagccttaa

SEQ ID NO: 679079 - DNA, 25 bp, Rattus norvegicus
ttgcctctttccacaattcatggtt

SEQ ID NO: 679080 - DNA, 25 bp, Rattus norvegicus
ttgcctctttcctcaattcatggtt

SEQ ID NO: 679081 - DNA, 25 bp, Rattus norvegicus
ttgcctctttgcatttgttgtacag

SEQ ID NO: 679082 - DNA, 25 bp, Rattus norvegicus
ttgcctctttgcttttgttgtacag

SEQ ID NO: 679083 - DNA, 25 bp, Rattus norvegicus
ttgcctgaagctcgattcgcgctgt

SEQ ID NO: 679084 - DNA, 25 bp, Rattus norvegicus
ttgcctgaagctggattcgcgctgt

SEQ ID NO: 679085 - DNA, 25 bp, Rattus norvegicus
ttgcctgaatcccacagaggacttc

SEQ ID NO: 679086 - DNA, 25 bp, Rattus norvegicus
ttgcctgaatccgacagaggacttc

SEQ ID NO: 679087 - DNA, 25 bp, Rattus norvegicus
ttgcctgacaacacctacatcatga

SEQ ID NO: 679088 - DNA, 25 bp, Rattus norvegicus
ttgcctgacaactcctacatcatga

SEQ ID NO: 679089 - DNA, 25 bp, Rattus norvegicus
ttgcctgacaagatcgaactgggtg

SEQ ID NO: 679090 - DNA, 25 bp, Rattus norvegicus
ttgcctgacaagttcgaactgggtg

SEQ ID NO: 679091 - DNA, 25 bp, Rattus norvegicus
ttgcctgacagtaccttcttgatta

SEQ ID NO: 679092 - DNA, 25 bp, Rattus norvegicus
ttgcctgacagttccttcttgatta

SEQ ID NO: 679093 - DNA, 25 bp, Rattus norvegicus
ttgcctgacctgaaaaccattgtga

SEQ ID NO: 679094 - DNA, 25 bp, Rattus norvegicus
ttgcctgacctgtaaaccattgtga

SEQ ID NO: 679095 - DNA, 25 bp, Rattus norvegicus
ttgcctgactcactaggataactca

SEQ ID NO: 679096 - DNA, 25 bp, Rattus norvegicus
ttgcctgactcagtaggataactca

SEQ ID NO: 679097 - DNA, 25 bp, Rattus norvegicus
ttgcctgagagtctgtcctcacgta

SEQ ID NO: 679098 - DNA, 25 bp, Rattus norvegicus
ttgcctgagagtgtgtcctcacgta

SEQ ID NO: 679099 - DNA, 25 bp, Rattus norvegicus
ttgcctgagctaacacttactgagt

SEQ ID NO: 679100 - DNA, 25 bp, Rattus norvegicus
ttgcctgagctatcacttactgagt

SEQ ID NO: 679101 - DNA, 25 bp, Rattus norvegicus
ttgcctgagtataaatgcttgcctg

SEQ ID NO: 679102 - DNA, 25 bp, Rattus norvegicus
ttgcctgagtattaatgcttgcctg

SEQ ID NO: 679103 - DNA, 25 bp, Rattus norvegicus
ttgcctgattctcagtttgtcctga

SEQ ID NO: 679104 - DNA, 25 bp, Rattus norvegicus
ttgcctgattctgagtttgtcctga

SEQ ID NO: 679105 - DNA, 25 bp, Rattus norvegicus
ttgcctgcaaacctcattccaggaa

SEQ ID NO: 679106 - DNA, 25 bp, Rattus norvegicus
ttgcctgcaaacgtcattccaggaa

SEQ ID NO: 679107 - DNA, 25 bp, Rattus norvegicus
ttgcctgcaaatatcatgatgtcct

SEQ ID NO: 679108 - DNA, 25 bp, Rattus norvegicus
ttgcctgcaaatttcatgatgtcct

SEQ ID NO: 679109 - DNA, 25 bp, Rattus norvegicus
ttgcctgcacagagagcatgagtgt

SEQ ID NO: 679110 - DNA, 25 bp, Rattus norvegicus
ttgcctgcacagtgagcatgagtgt

SEQ ID NO: 679111 - DNA, 25 bp, Rattus norvegicus
ttgcctgcagatcgaccagatgttc

SEQ ID NO: 679112 - DNA, 25 bp, Rattus norvegicus
ttgcctgcagatggaccagatgttc

SEQ ID NO: 679113 - DNA, 25 bp, Rattus norvegicus
ttgcctgcagcaacttgtgtgtaga

SEQ ID NO: 679114 - DNA, 25 bp, Rattus norvegicus
ttgcctgcagcatcttgtgtgtaga

SEQ ID NO: 679115 - DNA, 25 bp, Rattus norvegicus
ttgcctgcatcaaaccatcttgagg

SEQ ID NO: 679116 - DNA, 25 bp, Rattus norvegicus
ttgcctgcatcataccatcttgagg

SEQ ID NO: 679117 - DNA, 25 bp, Rattus norvegicus
ttgcctgccagtaacacttcaaaaa

SEQ ID NO: 679118 - DNA, 25 bp, Rattus norvegicus
ttgcctgccagttacacttcaaaaa

SEQ ID NO: 679119 - DNA, 25 bp, Rattus norvegicus
ttgcctgccatgctttcagagcaca

SEQ ID NO: 679120 - DNA, 25 bp, Rattus norvegicus
ttgcctgccatggtttcagagcaca

SEQ ID NO: 679121 - DNA, 25 bp, Rattus norvegicus
ttgcctgcccttctctggtggtcat

SEQ ID NO: 679122 - DNA, 25 bp, Rattus norvegicus
ttgcctgcccttgtctggtggtcat

SEQ ID NO: 679123 - DNA, 25 bp, Rattus norvegicus
ttgcctgccgagctgatctgagaag

SEQ ID NO: 679124 - DNA, 25 bp, Rattus norvegicus
ttgcctgccgaggtgatctgagaag

SEQ ID NO: 679125 - DNA, 25 bp, Rattus norvegicus
ttgcctgcgcatctgttacagtgca

SEQ ID NO: 679126 - DNA, 25 bp, Rattus norvegicus
ttgcctgcgcatgtgttacagtgca

SEQ ID NO: 679127 - DNA, 25 bp, Rattus norvegicus
ttgcctgctctgatttcaaggattc

SEQ ID NO: 679128 - DNA, 25 bp, Rattus norvegicus
ttgcctgctctgttttcaaggattc

SEQ ID NO: 679129 - DNA, 25 bp, Rattus norvegicus
ttgcctgcttttatgagattcccca

SEQ ID NO: 679130 - DNA, 25 bp, Rattus norvegicus
ttgcctgcttttttgagattcccca

SEQ ID NO: 679131 - DNA, 25 bp, Rattus norvegicus
ttgcctggaccgatggtcttgatga

SEQ ID NO: 679132 - DNA, 25 bp, Rattus norvegicus
ttgcctggaccgttggtcttgatga

SEQ ID NO: 679133 - DNA, 25 bp, Rattus norvegicus
ttgcctggatccctgtcgccactga

SEQ ID NO: 679134 - DNA, 25 bp, Rattus norvegicus
ttgcctggatccgtgtcgccactga

SEQ ID NO: 679135 - DNA, 25 bp, Rattus norvegicus
ttgcctggcatacccagtccctggg

SEQ ID NO: 679136 - DNA, 25 bp, Rattus norvegicus
ttgcctggcatagccagtccctggg

SEQ ID NO: 679137 - DNA, 25 bp, Rattus norvegicus
ttgcctggctccatgcatagtagct

SEQ ID NO: 679138 - DNA, 25 bp, Rattus norvegicus
ttgcctggctccttgcatagtagct

SEQ ID NO: 679139 - DNA, 25 bp, Rattus norvegicus
ttgcctggctctagacagtaacaca

SEQ ID NO: 679140 - DNA, 25 bp, Rattus norvegicus
ttgcctggctcttgacagtaacaca

SEQ ID NO: 679141 - DNA, 25 bp, Rattus norvegicus
ttgcctgggattacaaatgcctttg

SEQ ID NO: 679142 - DNA, 25 bp, Rattus norvegicus
ttgcctgggatttcaaatgcctttg

SEQ ID NO: 679143 - DNA, 25 bp, Rattus norvegicus
ttgcctgggcatagtcacagctgca

SEQ ID NO: 679144 - DNA, 25 bp, Rattus norvegicus
ttgcctgggcattgtcacagctgca

SEQ ID NO: 679145 - DNA, 25 bp, Rattus norvegicus
ttgcctggggtgagagagcccctcc

SEQ ID NO: 679146 - DNA, 25 bp, Rattus norvegicus
ttgcctggggtgtgagagcccctcc

SEQ ID NO: 679147 - DNA, 25 bp, Rattus norvegicus
ttgcctgggtcaaaccactcgaaac

SEQ ID NO: 679148 - DNA, 25 bp, Rattus norvegicus
ttgcctgggtcataccactcgaaac

SEQ ID NO: 679149 - DNA, 25 bp, Rattus norvegicus
ttgcctgtacagaaagctctccgga

SEQ ID NO: 679150 - DNA, 25 bp, Rattus norvegicus
ttgcctgtacagtaagctctccgga

SEQ ID NO: 679151 - DNA, 25 bp, Rattus norvegicus
ttgcctgtagccagtagtcacttgt

SEQ ID NO: 679152 - DNA, 25 bp, Rattus norvegicus
ttgcctgtagcctgtagtcacttgt

SEQ ID NO: 679153 - DNA, 25 bp, Rattus norvegicus
ttgcctgtaggtcaagtgctctaag

SEQ ID NO: 679154 - DNA, 25 bp, Rattus norvegicus
ttgcctgtaggtgaagtgctctaag

SEQ ID NO: 679155 - DNA, 25 bp, Rattus norvegicus
ttgcctgtagtaccaccctgatgga

SEQ ID NO: 679156 - DNA, 25 bp, Rattus norvegicus
ttgcctgtagtagcaccctgatgga

SEQ ID NO: 679157 - DNA, 25 bp, Rattus norvegicus
ttgcctgtatgtctttgcatgccac

SEQ ID NO: 679158 - DNA, 25 bp, Rattus norvegicus
ttgcctgtatgtgtttgcatgccac

SEQ ID NO: 679159 - DNA, 25 bp, Rattus norvegicus
ttgcctgtcagcctagaagttcacg

SEQ ID NO: 679160 - DNA, 25 bp, Rattus norvegicus
ttgcctgtcagcgtagaagttcacg

SEQ ID NO: 679161 - DNA, 25 bp, Rattus norvegicus
ttgcctgtccaactctatcagcaga

SEQ ID NO: 679162 - DNA, 25 bp, Rattus norvegicus
ttgcctgtccaagtctatcagcaga

SEQ ID NO: 679163 - DNA, 25 bp, Rattus norvegicus
ttgcctgtctcgcttgtgcagaaaa

SEQ ID NO: 679164 - DNA, 25 bp, Rattus norvegicus
ttgcctgtctcggttgtgcagaaaa

SEQ ID NO: 679165 - DNA, 25 bp, Rattus norvegicus
ttgcctgtctggaccttacactaca

SEQ ID NO: 679166 - DNA, 25 bp, Rattus norvegicus
ttgcctgtctggattcttttggatg

SEQ ID NO: 679167 - DNA, 25 bp, Rattus norvegicus
ttgcctgtctggtccttacactaca

SEQ ID NO: 679168 - DNA, 25 bp, Rattus norvegicus
ttgcctgtctggtttcttttggatg

SEQ ID NO: 679169 - DNA, 25 bp, Rattus norvegicus
ttgcctgtgaaaacctctctgatca

SEQ ID NO: 679170 - DNA, 25 bp, Rattus norvegicus
ttgcctgtgaaatcctctctgatca

SEQ ID NO: 679171 - DNA, 25 bp, Rattus norvegicus
ttgcctgtgagtactgtgggcgcaa

SEQ ID NO: 679172 - DNA, 25 bp, Rattus norvegicus
ttgcctgtgagttctgtgggcgcaa

SEQ ID NO: 679173 - DNA, 25 bp, Rattus norvegicus
ttgcctgttaccagtttcccagagc

SEQ ID NO: 679174 - DNA, 25 bp, Rattus norvegicus
ttgcctgttacctgtttcccagagc

SEQ ID NO: 679175 - DNA, 25 bp, Rattus norvegicus
ttgcctgttactatagttgttactg

SEQ ID NO: 679176 - DNA, 25 bp, Rattus norvegicus
ttgcctgttactttagttgttactg

SEQ ID NO: 679177 - DNA, 25 bp, Rattus norvegicus
ttgcctgttagtagctttgtagcca

SEQ ID NO: 679178 - DNA, 25 bp, Rattus norvegicus
ttgcctgttagttgctttgtagcca

SEQ ID NO: 679179 - DNA, 25 bp, Rattus norvegicus
ttgcctgttataattgtgacaatag

SEQ ID NO: 679180 - DNA, 25 bp, Rattus norvegicus
ttgcctgttatatttgtgacaatag

SEQ ID NO: 679181 - DNA, 25 bp, Rattus norvegicus
ttgcctgttcacaattgttctttca

SEQ ID NO: 679182 - DNA, 25 bp, Rattus norvegicus
ttgcctgttcactattgttctttca

SEQ ID NO: 679183 - DNA, 25 bp, Rattus norvegicus
ttgcctgtttatcttctaaagaggg

SEQ ID NO: 679184 - DNA, 25 bp, Rattus norvegicus
ttgcctgtttatgttctaaagaggg

SEQ ID NO: 679185 - DNA, 25 bp, Rattus norvegicus
ttgcctgtttctacctatatcctat

SEQ ID NO: 679186 - DNA, 25 bp, Rattus norvegicus
ttgcctgtttctctgactcttatga

SEQ ID NO: 679187 - DNA, 25 bp, Rattus norvegicus
ttgcctgtttctgtgactcttatga

SEQ ID NO: 679188 - DNA, 25 bp, Rattus norvegicus
ttgcctgtttcttcctatatcctat

SEQ ID NO: 679189 - DNA, 25 bp, Rattus norvegicus
ttgccttacagactagccatactta

SEQ ID NO: 679190 - DNA, 25 bp, Rattus norvegicus
ttgccttacagagtagccatactta

SEQ ID NO: 679191 - DNA, 25 bp, Rattus norvegicus
ttgccttacttcctggtcctgaaag

SEQ ID NO: 679192 - DNA, 25 bp, Rattus norvegicus
ttgccttacttcgtggtcctgaaag

SEQ ID NO: 679193 - DNA, 25 bp, Rattus norvegicus
ttgccttagggcattttgtactgtt

SEQ ID NO: 679194 - DNA, 25 bp, Rattus norvegicus
ttgccttagggctttttgtactgtt

SEQ ID NO: 679195 - DNA, 25 bp, Rattus norvegicus
ttgccttagtatctggctcccaagt

SEQ ID NO: 679196 - DNA, 25 bp, Rattus norvegicus
ttgccttagtatgtggctcccaagt

SEQ ID NO: 679197 - DNA, 25 bp, Rattus norvegicus
ttgccttagtctagtgagtgcttag

SEQ ID NO: 679198 - DNA, 25 bp, Rattus norvegicus
ttgccttagtcttgtgagtgcttag

SEQ ID NO: 679199 - DNA, 25 bp, Rattus norvegicus
ttgccttatattatcccaaacctct

SEQ ID NO: 679200 - DNA, 25 bp, Rattus norvegicus
ttgccttatattttcccaaacctct

SEQ ID NO: 679201 - DNA, 25 bp, Rattus norvegicus
ttgccttatgtcagaatgccacgga

SEQ ID NO: 679202 - DNA, 25 bp, Rattus norvegicus
ttgccttatgtctgaatgccacgga

SEQ ID NO: 679203 - DNA, 25 bp, Rattus norvegicus
ttgccttatgttatggtcctgattt

SEQ ID NO: 679204 - DNA, 25 bp, Rattus norvegicus
ttgccttatgttttggtcctgattt

SEQ ID NO: 679205 - DNA, 25 bp, Rattus norvegicus
ttgccttcaaggagacgtcacaaat

SEQ ID NO: 679206 - DNA, 25 bp, Rattus norvegicus
ttgccttcaaggtgacgtcacaaat

SEQ ID NO: 679207 - DNA, 25 bp, Rattus norvegicus
ttgccttcacaaccccaggagggta

SEQ ID NO: 679208 - DNA, 25 bp, Rattus norvegicus
ttgccttcacaagcccaggagggta

SEQ ID NO: 679209 - DNA, 25 bp, Rattus norvegicus
ttgccttcatttacatcttgtggtt

SEQ ID NO: 679210 - DNA, 25 bp, Rattus norvegicus
ttgccttcattttcatcttgtggtt

SEQ ID NO: 679211 - DNA, 25 bp, Rattus norvegicus
ttgccttcccagcatgagactacag

SEQ ID NO: 679212 - DNA, 25 bp, Rattus norvegicus
ttgccttcccaggatgagactacag

SEQ ID NO: 679213 - DNA, 25 bp, Rattus norvegicus
ttgccttccctgaaaatagccttag

SEQ ID NO: 679214 - DNA, 25 bp, Rattus norvegicus
ttgccttccctgtaaatagccttag

SEQ ID NO: 679215 - DNA, 25 bp, Rattus norvegicus
ttgccttccttcacctaagcataag

SEQ ID NO: 679216 - DNA, 25 bp, Rattus norvegicus
ttgccttccttctcctaagcataag

SEQ ID NO: 679217 - DNA, 25 bp, Rattus norvegicus
ttgccttccttgaaagaaaaaccag

SEQ ID NO: 679218 - DNA, 25 bp, Rattus norvegicus
ttgccttccttgtaagaaaaaccag

SEQ ID NO: 679219 - DNA, 25 bp, Rattus norvegicus
ttgccttcggtcacatgtacactaa

SEQ ID NO: 679220 - DNA, 25 bp, Rattus norvegicus
ttgccttcggtctcatgtacactaa

SEQ ID NO: 679221 - DNA, 25 bp, Rattus norvegicus
ttgccttcgtcgagggactcctcat

SEQ ID NO: 679222 - DNA, 25 bp, Rattus norvegicus
ttgccttcgtcgtgggactcctcat

SEQ ID NO: 679223 - DNA, 25 bp, Rattus norvegicus
ttgccttctagactcagcttttaac

SEQ ID NO: 679224 - DNA, 25 bp, Rattus norvegicus
ttgccttctagagtcagcttttaac

SEQ ID NO: 679225 - DNA, 25 bp, Rattus norvegicus
ttgccttctcaccacttaaaatttg

SEQ ID NO: 679226 - DNA, 25 bp, Rattus norvegicus
ttgccttctcacgacttaaaatttg

SEQ ID NO: 679227 - DNA, 25 bp, Rattus norvegicus
ttgccttctcagacttcatgctgta

SEQ ID NO: 679228 - DNA, 25 bp, Rattus norvegicus
ttgccttctcagtcttcatgctgta

SEQ ID NO: 679229 - DNA, 25 bp, Rattus norvegicus
ttgccttctcgtctttttctttcct

SEQ ID NO: 679230 - DNA, 25 bp, Rattus norvegicus
ttgccttctcgtgtttttctttcct

SEQ ID NO: 679231 - DNA, 25 bp, Rattus norvegicus
ttgccttctgcaactgattttgacc

SEQ ID NO: 679232 - DNA, 25 bp, Rattus norvegicus
ttgccttctgcatctgattttgacc

SEQ ID NO: 679233 - DNA, 25 bp, Rattus norvegicus
ttgccttctgctctttcggaccctt

SEQ ID NO: 679234 - DNA, 25 bp, Rattus norvegicus
ttgccttctgctgtttcggaccctt

SEQ ID NO: 679235 - DNA, 25 bp, Rattus norvegicus
ttgccttctgttacttccagggaat

SEQ ID NO: 679236 - DNA, 25 bp, Rattus norvegicus
ttgccttctgtttcttccagggaat

SEQ ID NO: 679237 - DNA, 25 bp, Rattus norvegicus
ttgccttgcatcacagagcctttgg

SEQ ID NO: 679238 - DNA, 25 bp, Rattus norvegicus
ttgccttgcatcatagagagaccaa

SEQ ID NO: 679239 - DNA, 25 bp, Rattus norvegicus
ttgccttgcatctcagagcctttgg

SEQ ID NO: 679240 - DNA, 25 bp, Rattus norvegicus
ttgccttgcatcttagagagaccaa

SEQ ID NO: 679241 - DNA, 25 bp, Rattus norvegicus
ttgccttggccaaggcgatagcccc

SEQ ID NO: 679242 - DNA, 25 bp, Rattus norvegicus
ttgccttggccatggcgatagcccc

SEQ ID NO: 679243 - DNA, 25 bp, Rattus norvegicus
ttgccttgggacctatctgattata

SEQ ID NO: 679244 - DNA, 25 bp, Rattus norvegicus
ttgccttgggacgtatctgattata

SEQ ID NO: 679245 - DNA, 25 bp, Rattus norvegicus
ttgccttggtctatgtgtttcatca

SEQ ID NO: 679246 - DNA, 25 bp, Rattus norvegicus
ttgccttggtctttgtgtttcatca

SEQ ID NO: 679247 - DNA, 25 bp, Rattus norvegicus
ttgccttgtatgactgactttgcac

SEQ ID NO: 679248 - DNA, 25 bp, Rattus norvegicus
ttgccttgtatgtctgactttgcac

SEQ ID NO: 679249 - DNA, 25 bp, Rattus norvegicus
ttgccttgtggaacgctaaagcccc

SEQ ID NO: 679250 - DNA, 25 bp, Rattus norvegicus
ttgccttgtggaattcacagtgcat

SEQ ID NO: 679251 - DNA, 25 bp, Rattus norvegicus
ttgccttgtggatcgctaaagcccc

SEQ ID NO: 679252 - DNA, 25 bp, Rattus norvegicus
ttgccttgtggatttcacagtgcat

SEQ ID NO: 679253 - DNA, 25 bp, Rattus norvegicus
ttgccttgtggcagactcactaagc

SEQ ID NO: 679254 - DNA, 25 bp, Rattus norvegicus
ttgccttgtggccacaatgtgacta

SEQ ID NO: 679255 - DNA, 25 bp, Rattus norvegicus
ttgccttgtggcctaggtgaagcat

SEQ ID NO: 679256 - DNA, 25 bp, Rattus norvegicus
ttgccttgtggcgacaatgtgacta

SEQ ID NO: 679257 - DNA, 25 bp, Rattus norvegicus
ttgccttgtggcgtaggtgaagcat

SEQ ID NO: 679258 - DNA, 25 bp, Rattus norvegicus
ttgccttgtggctgactcactaagc

SEQ ID NO: 679259 - DNA, 25 bp, Rattus norvegicus
ttgccttgtgtgcagtcccattaga

SEQ ID NO: 679260 - DNA, 25 bp, Rattus norvegicus
ttgccttgtgtggagtcccattaga

SEQ ID NO: 679261 - DNA, 25 bp, Rattus norvegicus
ttgcctttatgtaagtctgcgccac

SEQ ID NO: 679262 - DNA, 25 bp, Rattus norvegicus
ttgcctttatgttagtctgcgccac

SEQ ID NO: 679263 - DNA, 25 bp, Rattus norvegicus
ttgcctttcaggagccttcaggtta

SEQ ID NO: 679264 - DNA, 25 bp, Rattus norvegicus
ttgcctttcaggtgccttcaggtta

SEQ ID NO: 679265 - DNA, 25 bp, Rattus norvegicus
ttgcctttcattacggtattgccca

SEQ ID NO: 679266 - DNA, 25 bp, Rattus norvegicus
ttgcctttcatttcggtattgccca

SEQ ID NO: 679267 - DNA, 25 bp, Rattus norvegicus
ttgcctttcggaaccttcgcgtgtg

SEQ ID NO: 679268 - DNA, 25 bp, Rattus norvegicus
ttgcctttcggatccttcgcgtgtg

SEQ ID NO: 679269 - DNA, 25 bp, Rattus norvegicus
ttgcctttctgcatttgtaattgtt

SEQ ID NO: 679270 - DNA, 25 bp, Rattus norvegicus
ttgcctttctgcttttgtaattgtt

SEQ ID NO: 679271 - DNA, 25 bp, Rattus norvegicus
ttgcctttcttactgactccctgtt

SEQ ID NO: 679272 - DNA, 25 bp, Rattus norvegicus
ttgcctttcttagtgactccctgtt

SEQ ID NO: 679273 - DNA, 25 bp, Rattus norvegicus
ttgcctttgactccctgacttcaag

SEQ ID NO: 679274 - DNA, 25 bp, Rattus norvegicus
ttgcctttgactgcctgacttcaag

SEQ ID NO: 679275 - DNA, 25 bp, Rattus norvegicus
ttgcctttgattatgactatgggaa

SEQ ID NO: 679276 - DNA, 25 bp, Rattus norvegicus
ttgcctttgattttgactatgggaa

SEQ ID NO: 679277 - DNA, 25 bp, Rattus norvegicus
ttgcctttgcgcagttgtattcacg

SEQ ID NO: 679278 - DNA, 25 bp, Rattus norvegicus
ttgcctttgcgctgttgtattcacg

SEQ ID NO: 679279 - DNA, 25 bp, Rattus norvegicus
ttgcctttggcacacttgcgccata

SEQ ID NO: 679280 - DNA, 25 bp, Rattus norvegicus
ttgcctttggcagacttgcgccata

SEQ ID NO: 679281 - DNA, 25 bp, Rattus norvegicus
ttgcctttgggacattgggaatatc

SEQ ID NO: 679282 - DNA, 25 bp, Rattus norvegicus
ttgcctttgggagattgggaatatc

SEQ ID NO: 679283 - DNA, 25 bp, Rattus norvegicus
ttgcctttggtcctggtatttcatt

SEQ ID NO: 679284 - DNA, 25 bp, Rattus norvegicus
ttgcctttggtcgtggtatttcatt

SEQ ID NO: 679285 - DNA, 25 bp, Rattus norvegicus
ttgcctttgtacatcttctgtcaac

SEQ ID NO: 679286 - DNA, 25 bp, Rattus norvegicus
ttgcctttgtacctctgggatctga

SEQ ID NO: 679287 - DNA, 25 bp, Rattus norvegicus
ttgcctttgtacgtctgggatctga

SEQ ID NO: 679288 - DNA, 25 bp, Rattus norvegicus
ttgcctttgtacttcttctgtcaac

SEQ ID NO: 679289 - DNA, 25 bp, Rattus norvegicus
ttgcctttgtctctggttcaaccat

SEQ ID NO: 679290 - DNA, 25 bp, Rattus norvegicus
ttgcctttgtctgtggttcaaccat

SEQ ID NO: 679291 - DNA, 25 bp, Rattus norvegicus
ttgcctttgttcctagttactgtaa

SEQ ID NO: 679292 - DNA, 25 bp, Rattus norvegicus
ttgcctttgttcgtagttactgtaa

SEQ ID NO: 679293 - DNA, 25 bp, Rattus norvegicus
ttgcctttgtttcccgagtgctgga

SEQ ID NO: 679294 - DNA, 25 bp, Rattus norvegicus
ttgcctttgtttgccgagtgctgga

SEQ ID NO: 679295 - DNA, 25 bp, Rattus norvegicus
ttgccttttaaaatgctattctgtg

SEQ ID NO: 679296 - DNA, 25 bp, Rattus norvegicus
ttgccttttaaattgctattctgtg

SEQ ID NO: 679297 - DNA, 25 bp, Rattus norvegicus
ttgccttttcataaccgcccatgaa

SEQ ID NO: 679298 - DNA, 25 bp, Rattus norvegicus
ttgccttttcatacaccgctgggtc

SEQ ID NO: 679299 - DNA, 25 bp, Rattus norvegicus
ttgccttttcattaccgcccatgaa

SEQ ID NO: 679300 - DNA, 25 bp, Rattus norvegicus
ttgccttttcattcaccgctgggtc

SEQ ID NO: 679301 - DNA, 25 bp, Rattus norvegicus
ttgccttttctgagacagtggtccc

SEQ ID NO: 679302 - DNA, 25 bp, Rattus norvegicus
ttgccttttctgtgacagtggtccc

SEQ ID NO: 679303 - DNA, 25 bp, Rattus norvegicus
ttgccttttcttaccgtatgttatt

SEQ ID NO: 679304 - DNA, 25 bp, Rattus norvegicus
ttgccttttctttccgtatgttatt

SEQ ID NO: 679305 - DNA, 25 bp, Rattus norvegicus
ttgcctttttcaagcctttcaggaa

SEQ ID NO: 679306 - DNA, 25 bp, Rattus norvegicus
ttgcctttttcatgcctttcaggaa

SEQ ID NO: 679307 - DNA, 25 bp, Rattus norvegicus
ttgcgaagaactagtcccacttgga

SEQ ID NO: 679308 - DNA, 25 bp, Rattus norvegicus
ttgcgaagaacttgtcccacttgga

SEQ ID NO: 679309 - DNA, 25 bp, Rattus norvegicus
ttgcgaagagtgctatctcctccca

SEQ ID NO: 679310 - DNA, 25 bp, Rattus norvegicus
ttgcgaagagtggtatctcctccca

SEQ ID NO: 679311 - DNA, 25 bp, Rattus norvegicus
ttgcgaaggtcccatgtttgattcc

SEQ ID NO: 679312 - DNA, 25 bp, Rattus norvegicus
ttgcgaaggtccgatgtttgattcc

SEQ ID NO: 679313 - DNA, 25 bp, Rattus norvegicus
ttgcgaagtctgagccaatcaggtt

SEQ ID NO: 679314 - DNA, 25 bp, Rattus norvegicus
ttgcgaagtctgtgccaatcaggtt

SEQ ID NO: 679315 - DNA, 25 bp, Rattus norvegicus
ttgcgaatcgccatggtggagccgc

SEQ ID NO: 679316 - DNA, 25 bp, Rattus norvegicus
ttgcgaatcgccttggtggagccgc

SEQ ID NO: 679317 - DNA, 25 bp, Rattus norvegicus
ttgcgaattcgtcttcctcctgtgc

SEQ ID NO: 679318 - DNA, 25 bp, Rattus norvegicus
ttgcgaattcgtgttcctcctgtgc

SEQ ID NO: 679319 - DNA, 25 bp, Rattus norvegicus
ttgcgacagcagctcgacgaactga

SEQ ID NO: 679320 - DNA, 25 bp, Rattus norvegicus
ttgcgacagcaggtcgacgaactga

SEQ ID NO: 679321 - DNA, 25 bp, Rattus norvegicus
ttgcgacatggaagcattgacctat

SEQ ID NO: 679322 - DNA, 25 bp, Rattus norvegicus
ttgcgacatggatgcattgacctat

SEQ ID NO: 679323 - DNA, 25 bp, Rattus norvegicus
ttgcgacccctaagcggtgacggaa

SEQ ID NO: 679324 - DNA, 25 bp, Rattus norvegicus
ttgcgacccctatgcggtgacggaa

SEQ ID NO: 679325 - DNA, 25 bp, Rattus norvegicus
ttgcgacctcacaggacagcggtga

SEQ ID NO: 679326 - DNA, 25 bp, Rattus norvegicus
ttgcgacctcactggacagcggtga

SEQ ID NO: 679327 - DNA, 25 bp, Rattus norvegicus
ttgcgacctggtacatctgaactgc

SEQ ID NO: 679328 - DNA, 25 bp, Rattus norvegicus
ttgcgacctggttcatctgaactgc

SEQ ID NO: 679329 - DNA, 25 bp, Rattus norvegicus
ttgcgacggaggatggtactgccca

SEQ ID NO: 679330 - DNA, 25 bp, Rattus norvegicus
ttgcgacggaggttggtactgccca

SEQ ID NO: 679331 - DNA, 25 bp, Rattus norvegicus
ttgcgacgtagaactccgccgcatg

SEQ ID NO: 679332 - DNA, 25 bp, Rattus norvegicus
ttgcgacgtagatctccgccgcatg

SEQ ID NO: 679333 - DNA, 25 bp, Rattus norvegicus
ttgcgactctaaacacatccacgtg

SEQ ID NO: 679334 - DNA, 25 bp, Rattus norvegicus
ttgcgactctaatcacatccacgtg

SEQ ID NO: 679335 - DNA, 25 bp, Rattus norvegicus
ttgcgagaccgtaaggctctggatt

SEQ ID NO: 679336 - DNA, 25 bp, Rattus norvegicus
ttgcgagaccgttaggctctggatt

SEQ ID NO: 679337 - DNA, 25 bp, Rattus norvegicus
ttgcgagcagcaccctggattcaca

SEQ ID NO: 679338 - DNA, 25 bp, Rattus norvegicus
ttgcgagcagcagcctggattcaca

SEQ ID NO: 679339 - DNA, 25 bp, Rattus norvegicus
ttgcgagcccaaaagccacagatac

SEQ ID NO: 679340 - DNA, 25 bp, Rattus norvegicus
ttgcgagcccaatagccacagatac

SEQ ID NO: 679341 - DNA, 25 bp, Rattus norvegicus
ttgcgagcctgaatttcacgacggt

SEQ ID NO: 679342 - DNA, 25 bp, Rattus norvegicus
ttgcgagcctgattttcacgacggt

SEQ ID NO: 679343 - DNA, 25 bp, Rattus norvegicus
ttgcgaggtttgatcagcttatctt

SEQ ID NO: 679344 - DNA, 25 bp, Rattus norvegicus
ttgcgaggtttgttcagcttatctt

SEQ ID NO: 679345 - DNA, 25 bp, Rattus norvegicus
ttgcgagtagatcagggcccctctt

SEQ ID NO: 679346 - DNA, 25 bp, Rattus norvegicus
ttgcgagtagatgagggcccctctt

SEQ ID NO: 679347 - DNA, 25 bp, Rattus norvegicus
ttgcgagtagcaaatcacccaagct

SEQ ID NO: 679348 - DNA, 25 bp, Rattus norvegicus
ttgcgagtagcatatcacccaagct

SEQ ID NO: 679349 - DNA, 25 bp, Rattus norvegicus
ttgcgagtggcgagtaatccaacgt

SEQ ID NO: 679350 - DNA, 25 bp, Rattus norvegicus
ttgcgagtggcgtgtaatccaacgt

SEQ ID NO: 679351 - DNA, 25 bp, Rattus norvegicus
ttgcgagttctcagctatgtataaa

SEQ ID NO: 679352 - DNA, 25 bp, Rattus norvegicus
ttgcgagttctctgctatgtataaa

SEQ ID NO: 679353 - DNA, 25 bp, Rattus norvegicus
ttgcgatctggccatgtaccacagt

SEQ ID NO: 679354 - DNA, 25 bp, Rattus norvegicus
ttgcgatctggcgatgtaccacagt

SEQ ID NO: 679355 - DNA, 25 bp, Rattus norvegicus
ttgcgcaagggaaactactcggagc

SEQ ID NO: 679356 - DNA, 25 bp, Rattus norvegicus
ttgcgcaagggatactactcggagc

SEQ ID NO: 679357 - DNA, 25 bp, Rattus norvegicus
ttgcgcaccaagactttatcccaaa

SEQ ID NO: 679358 - DNA, 25 bp, Rattus norvegicus
ttgcgcaccaagtctttatcccaaa

SEQ ID NO: 679359 - DNA, 25 bp, Rattus norvegicus
ttgcgcaccgagaagtcgtggaact

SEQ ID NO: 679360 - DNA, 25 bp, Rattus norvegicus
ttgcgcaccgagtagtcgtggaact

SEQ ID NO: 679361 - DNA, 25 bp, Rattus norvegicus
ttgcgcaccgatatccgggtgaagc

SEQ ID NO: 679362 - DNA, 25 bp, Rattus norvegicus
ttgcgcaccgatttccgggtgaagc

SEQ ID NO: 679363 - DNA, 25 bp, Rattus norvegicus
ttgcgcactcctatgcatgtgaata

SEQ ID NO: 679364 - DNA, 25 bp, Rattus norvegicus
ttgcgcactcctttgcatgtgaata

SEQ ID NO: 679365 - DNA, 25 bp, Rattus norvegicus
ttgcgcagcaggaaactgcccgagt

SEQ ID NO: 679366 - DNA, 25 bp, Rattus norvegicus
ttgcgcagcaggtaactgcccgagt

SEQ ID NO: 679367 - DNA, 25 bp, Rattus norvegicus
ttgcgcagtgcccttcacacatgag

SEQ ID NO: 679368 - DNA, 25 bp, Rattus norvegicus
ttgcgcagtgccgttcacacatgag

SEQ ID NO: 679369 - DNA, 25 bp, Rattus norvegicus
ttgcgccaatttacacaagtgtttg

SEQ ID NO: 679370 - DNA, 25 bp, Rattus norvegicus
ttgcgccaattttcacaagtgtttg

SEQ ID NO: 679371 - DNA, 25 bp, Rattus norvegicus
ttgcgccaggctactgtgagtgaca

SEQ ID NO: 679372 - DNA, 25 bp, Rattus norvegicus
ttgcgccaggcttctgtgagtgaca

SEQ ID NO: 679373 - DNA, 25 bp, Rattus norvegicus
ttgcgccagggcaactgtgaatggt

SEQ ID NO: 679374 - DNA, 25 bp, Rattus norvegicus
ttgcgccagggctactgtgaatggt

SEQ ID NO: 679375 - DNA, 25 bp, Rattus norvegicus
ttgcgccagtgaccaatctctcttg

SEQ ID NO: 679376 - DNA, 25 bp, Rattus norvegicus
ttgcgccagtgagcaatctctcttg

SEQ ID NO: 679377 - DNA, 25 bp, Rattus norvegicus
ttgcgccgcagcacgccgggcattg

SEQ ID NO: 679378 - DNA, 25 bp, Rattus norvegicus
ttgcgccgcagctcgccgggcattg

SEQ ID NO: 679379 - DNA, 25 bp, Rattus norvegicus
ttgcgccgcttcaccatgatcaagt

SEQ ID NO: 679380 - DNA, 25 bp, Rattus norvegicus
ttgcgccgcttctccatgatcaagt

SEQ ID NO: 679381 - DNA, 25 bp, Rattus norvegicus
ttgcgcgcaaacacgttggcagtgt

SEQ ID NO: 679382 - DNA, 25 bp, Rattus norvegicus
ttgcgcgcaaactcgttggcagtgt

SEQ ID NO: 679383 - DNA, 25 bp, Rattus norvegicus
ttgcgctaagatagtttgacctcat

SEQ ID NO: 679384 - DNA, 25 bp, Rattus norvegicus
ttgcgctaagattgtttgacctcat

SEQ ID NO: 679385 - DNA, 25 bp, Rattus norvegicus
ttgcgctaccgtaggctgagctgct

SEQ ID NO: 679386 - DNA, 25 bp, Rattus norvegicus
ttgcgctaccgttggctgagctgct

SEQ ID NO: 679387 - DNA, 25 bp, Rattus norvegicus
ttgcgctatgggatgccatcagcca

SEQ ID NO: 679388 - DNA, 25 bp, Rattus norvegicus
ttgcgctatgggttgccatcagcca

SEQ ID NO: 679389 - DNA, 25 bp, Rattus norvegicus
ttgcgctattacacccttggaatta

SEQ ID NO: 679390 - DNA, 25 bp, Rattus norvegicus
ttgcgctattactcccttggaatta

SEQ ID NO: 679391 - DNA, 25 bp, Rattus norvegicus
ttgcgctcagccagcactgacagtt

SEQ ID NO: 679392 - DNA, 25 bp, Rattus norvegicus
ttgcgctcagccaggaaaagcccgt

SEQ ID NO: 679393 - DNA, 25 bp, Rattus norvegicus
ttgcgctcagcctgcactgacagtt

SEQ ID NO: 679394 - DNA, 25 bp, Rattus norvegicus
ttgcgctcagcctggaaaagcccgt

SEQ ID NO: 679395 - DNA, 25 bp, Rattus norvegicus
ttgcgctcccggagcatgctgttct

SEQ ID NO: 679396 - DNA, 25 bp, Rattus norvegicus
ttgcgctcccggtgcatgctgttct

SEQ ID NO: 679397 - DNA, 25 bp, Rattus norvegicus
ttgcgctgctccatgaggctgagga

SEQ ID NO: 679398 - DNA, 25 bp, Rattus norvegicus
ttgcgctgctccttgaggctgagga

SEQ ID NO: 679399 - DNA, 25 bp, Rattus norvegicus
ttgcgcttagttagtggactccgtt

SEQ ID NO: 679400 - DNA, 25 bp, Rattus norvegicus
ttgcgcttagtttgtggactccgtt

SEQ ID NO: 679401 - DNA, 25 bp, Rattus norvegicus
ttgcgcttctctcctgtcgggatag

SEQ ID NO: 679402 - DNA, 25 bp, Rattus norvegicus
ttgcgcttctctgctgtcgggatag

SEQ ID NO: 679403 - DNA, 25 bp, Rattus norvegicus
ttgcgcttctgactgttagacacca

SEQ ID NO: 679404 - DNA, 25 bp, Rattus norvegicus
ttgcgcttctgagtgttagacacca

SEQ ID NO: 679405 - DNA, 25 bp, Rattus norvegicus
ttgcgcttgctacgtcagtgcactg

SEQ ID NO: 679406 - DNA, 25 bp, Rattus norvegicus
ttgcgcttgctaggtcagtgcactg

SEQ ID NO: 679407 - DNA, 25 bp, Rattus norvegicus
ttgcgcttgctgcagtgtctaggac

SEQ ID NO: 679408 - DNA, 25 bp, Rattus norvegicus
ttgcgcttgctggagtgtctaggac

SEQ ID NO: 679409 - DNA, 25 bp, Rattus norvegicus
ttgcggaacacaccagtggcagcct

SEQ ID NO: 679410 - DNA, 25 bp, Rattus norvegicus
ttgcggaacacagcagtggcagcct

SEQ ID NO: 679411 - DNA, 25 bp, Rattus norvegicus
ttgcggaagaccaccacggtcaaga

SEQ ID NO: 679412 - DNA, 25 bp, Rattus norvegicus
ttgcggaagacctccacggtcaaga

SEQ ID NO: 679413 - DNA, 25 bp, Rattus norvegicus
ttgcggaggatcagcgaaggttcta

SEQ ID NO: 679414 - DNA, 25 bp, Rattus norvegicus
ttgcggaggatctgcgaaggttcta

SEQ ID NO: 679415 - DNA, 25 bp, Rattus norvegicus
ttgcggaggcttcggaccattataa

SEQ ID NO: 679416 - DNA, 25 bp, Rattus norvegicus
ttgcggaggcttgggaccattataa

SEQ ID NO: 679417 - DNA, 25 bp, Rattus norvegicus
ttgcggatcgcacggttgtaaccat

SEQ ID NO: 679418 - DNA, 25 bp, Rattus norvegicus
ttgcggatcgcagggttgtaaccat

SEQ ID NO: 679419 - DNA, 25 bp, Rattus norvegicus
ttgcggatgggcaagctgcaccaaa

SEQ ID NO: 679420 - DNA, 25 bp, Rattus norvegicus
ttgcggatgggctagctgcaccaaa

SEQ ID NO: 679421 - DNA, 25 bp, Rattus norvegicus
ttgcggcagcccatgatcttagaga

SEQ ID NO: 679422 - DNA, 25 bp, Rattus norvegicus
ttgcggcagcccttgatcttagaga

SEQ ID NO: 679423 - DNA, 25 bp, Rattus norvegicus
ttgcggccccttcatgaagagttga

SEQ ID NO: 679424 - DNA, 25 bp, Rattus norvegicus
ttgcggccccttgatgaagagttga

SEQ ID NO: 679425 - DNA, 25 bp, Rattus norvegicus
ttgcggccggacagagcggattaaa

SEQ ID NO: 679426 - DNA, 25 bp, Rattus norvegicus
ttgcggccggactgagcggattaaa

SEQ ID NO: 679427 - DNA, 25 bp, Rattus norvegicus
ttgcggccttaacttttgatgttag

SEQ ID NO: 679428 - DNA, 25 bp, Rattus norvegicus
ttgcggccttaagttttgatgttag

SEQ ID NO: 679429 - DNA, 25 bp, Rattus norvegicus
ttgcggcgcggcaggtagatcacct

SEQ ID NO: 679430 - DNA, 25 bp, Rattus norvegicus
ttgcggcgcggctggtagatcacct

SEQ ID NO: 679431 - DNA, 25 bp, Rattus norvegicus
ttgcggctcgtgctataatttcaga

SEQ ID NO: 679432 - DNA, 25 bp, Rattus norvegicus
ttgcggctcgtggtataatttcaga

SEQ ID NO: 679433 - DNA, 25 bp, Rattus norvegicus
ttgcggctctgtacacatttttaaa

SEQ ID NO: 679434 - DNA, 25 bp, Rattus norvegicus
ttgcggctctgttcacatttttaaa

SEQ ID NO: 679435 - DNA, 25 bp, Rattus norvegicus
ttgcggctggtgacagagactcaca

SEQ ID NO: 679436 - DNA, 25 bp, Rattus norvegicus
ttgcggctggtgtcagagactcaca

SEQ ID NO: 679437 - DNA, 25 bp, Rattus norvegicus
ttgcggctgtctaccgtggacggat

SEQ ID NO: 679438 - DNA, 25 bp, Rattus norvegicus
ttgcggctgtcttccgtggacggat

SEQ ID NO: 679439 - DNA, 25 bp, Rattus norvegicus
ttgcgggaatttaggaaggccctgc

SEQ ID NO: 679440 - DNA, 25 bp, Rattus norvegicus
ttgcgggaattttggaaggccctgc

SEQ ID NO: 679441 - DNA, 25 bp, Rattus norvegicus
ttgcgggacaaaccgagttccactc

SEQ ID NO: 679442 - DNA, 25 bp, Rattus norvegicus
ttgcgggacaaagcgagttccactc

SEQ ID NO: 679443 - DNA, 25 bp, Rattus norvegicus
ttgcgggccatcactcatgagcact

SEQ ID NO: 679444 - DNA, 25 bp, Rattus norvegicus
ttgcgggccatctctcatgagcact

SEQ ID NO: 679445 - DNA, 25 bp, Rattus norvegicus
ttgcgggctgttcatcgatttcata

SEQ ID NO: 679446 - DNA, 25 bp, Rattus norvegicus
ttgcgggctgttgatcgatttcata

SEQ ID NO: 679447 - DNA, 25 bp, Rattus norvegicus
ttgcgggctttgattcacaagtaaa

SEQ ID NO: 679448 - DNA, 25 bp, Rattus norvegicus
ttgcgggctttgtttcacaagtaaa

SEQ ID NO: 679449 - DNA, 25 bp, Rattus norvegicus
ttgcgggtgccgatccttttaggag

SEQ ID NO: 679450 - DNA, 25 bp, Rattus norvegicus
ttgcgggtgccgttccttttaggag

SEQ ID NO: 679451 - DNA, 25 bp, Rattus norvegicus
ttgcgggtggttacagattagtctc

SEQ ID NO: 679452 - DNA, 25 bp, Rattus norvegicus
ttgcgggtggtttcagattagtctc

SEQ ID NO: 679453 - DNA, 25 bp, Rattus norvegicus
ttgcggtagactccagaaagcctcc

SEQ ID NO: 679454 - DNA, 25 bp, Rattus norvegicus
ttgcggtagactgcagaaagcctcc

SEQ ID NO: 679455 - DNA, 25 bp, Rattus norvegicus
ttgcggtcgtacatgacggtgacct

SEQ ID NO: 679456 - DNA, 25 bp, Rattus norvegicus
ttgcggtcgtacttgacggtgacct

SEQ ID NO: 679457 - DNA, 25 bp, Rattus norvegicus
ttgcggtgctggagcgaatccctca

SEQ ID NO: 679458 - DNA, 25 bp, Rattus norvegicus
ttgcggtgctggtgcgaatccctca

SEQ ID NO: 679459 - DNA, 25 bp, Rattus norvegicus
ttgcggttctggattggcgatactc

SEQ ID NO: 679460 - DNA, 25 bp, Rattus norvegicus
ttgcggttctggtttggcgatactc

SEQ ID NO: 679461 - DNA, 25 bp, Rattus norvegicus
ttgcggtttagcacagggacctgtt

SEQ ID NO: 679462 - DNA, 25 bp, Rattus norvegicus
ttgcggtttagctcagggacctgtt

SEQ ID NO: 679463 - DNA, 25 bp, Rattus norvegicus
ttgcgtaaattcacgcctgacgggc

SEQ ID NO: 679464 - DNA, 25 bp, Rattus norvegicus
ttgcgtaaattctcgcctgacgggc

SEQ ID NO: 679465 - DNA, 25 bp, Rattus norvegicus
ttgcgtaattcgcacaatgattcag

SEQ ID NO: 679466 - DNA, 25 bp, Rattus norvegicus
ttgcgtaattcggacaatgattcag

SEQ ID NO: 679467 - DNA, 25 bp, Rattus norvegicus
ttgcgtaattgcctgtctaatgccc

SEQ ID NO: 679468 - DNA, 25 bp, Rattus norvegicus
ttgcgtaattgcgtgtctaatgccc

SEQ ID NO: 679469 - DNA, 25 bp, Rattus norvegicus
ttgcgtactacacaagcggcttcaa

SEQ ID NO: 679470 - DNA, 25 bp, Rattus norvegicus
ttgcgtactacagaagcggcttcaa

SEQ ID NO: 679471 - DNA, 25 bp, Rattus norvegicus
ttgcgtattctgatggtgcctgctg

SEQ ID NO: 679472 - DNA, 25 bp, Rattus norvegicus
ttgcgtattctgttggtgcctgctg

SEQ ID NO: 679473 - DNA, 25 bp, Rattus norvegicus
ttgcgtcacggcaggacaagcagtt

SEQ ID NO: 679474 - DNA, 25 bp, Rattus norvegicus
ttgcgtcacggctggacaagcagtt

SEQ ID NO: 679475 - DNA, 25 bp, Rattus norvegicus
ttgcgtcccgctccacaggcaaggg

SEQ ID NO: 679476 - DNA, 25 bp, Rattus norvegicus
ttgcgtcccgctgcacaggcaaggg

SEQ ID NO: 679477 - DNA, 25 bp, Rattus norvegicus
ttgcgtctgtcaattctgttccttc

SEQ ID NO: 679478 - DNA, 25 bp, Rattus norvegicus
ttgcgtctgtcatttctgttccttc

SEQ ID NO: 679479 - DNA, 25 bp, Rattus norvegicus
ttgcgtgccatgagacaaacgaagt

SEQ ID NO: 679480 - DNA, 25 bp, Rattus norvegicus
ttgcgtgccatgtgacaaacgaagt

SEQ ID NO: 679481 - DNA, 25 bp, Rattus norvegicus
ttgcgtgcctgcaggagtccccagc

SEQ ID NO: 679482 - DNA, 25 bp, Rattus norvegicus
ttgcgtgcctgctggagtccccagc

SEQ ID NO: 679483 - DNA, 25 bp, Rattus norvegicus
ttgcgtgctctactcgatcacagga

SEQ ID NO: 679484 - DNA, 25 bp, Rattus norvegicus
ttgcgtgctctagtcgatcacagga

SEQ ID NO: 679485 - DNA, 25 bp, Rattus norvegicus
ttgcgtgtataaatgcttcccaccc

SEQ ID NO: 679486 - DNA, 25 bp, Rattus norvegicus
ttgcgtgtataattgcttcccaccc

SEQ ID NO: 679487 - DNA, 25 bp, Rattus norvegicus
ttgcgtgtatgtatagaaccagcgt

SEQ ID NO: 679488 - DNA, 25 bp, Rattus norvegicus
ttgcgtgtatgtttagaaccagcgt

SEQ ID NO: 679489 - DNA, 25 bp, Rattus norvegicus
ttgcgtgtccatagttttcatccag

SEQ ID NO: 679490 - DNA, 25 bp, Rattus norvegicus
ttgcgtgtccattgttttcatccag

SEQ ID NO: 679491 - DNA, 25 bp, Rattus norvegicus
ttgcgttcaggcaccatagctctgt

SEQ ID NO: 679492 - DNA, 25 bp, Rattus norvegicus
ttgcgttcaggctccatagctctgt

SEQ ID NO: 679493 - DNA, 25 bp, Rattus norvegicus
ttgcgttcgcggacggaaccccgat

SEQ ID NO: 679494 - DNA, 25 bp, Rattus norvegicus
ttgcgttcgcggtcggaaccccgat

SEQ ID NO: 679495 - DNA, 25 bp, Rattus norvegicus
ttgcgttctattcgcccagacaata

SEQ ID NO: 679496 - DNA, 25 bp, Rattus norvegicus
ttgcgttctattggcccagacaata

SEQ ID NO: 679497 - DNA, 25 bp, Rattus norvegicus
ttgcgttgggccagtcgttcctgga

SEQ ID NO: 679498 - DNA, 25 bp, Rattus norvegicus
ttgcgttgggcctgtcgttcctgga

SEQ ID NO: 679499 - DNA, 25 bp, Rattus norvegicus
ttgcgttgtcctccatgtgttaaac

SEQ ID NO: 679500 - DNA, 25 bp, Rattus norvegicus
ttgcgttgtcctgcatgtgttaaac

SEQ ID NO: 679501 - DNA, 25 bp, Rattus norvegicus
ttgcgtttccccatattgttttgtt

SEQ ID NO: 679502 - DNA, 25 bp, Rattus norvegicus
ttgcgtttccccttattgttttgtt

SEQ ID NO: 679503 - DNA, 25 bp, Rattus norvegicus
ttgcgtttctcaattctacagcgtc

SEQ ID NO: 679504 - DNA, 25 bp, Rattus norvegicus
ttgcgtttctcatttctacagcgtc

SEQ ID NO: 679505 - DNA, 25 bp, Rattus norvegicus
ttgcgttttctaacctcttctaaag

SEQ ID NO: 679506 - DNA, 25 bp, Rattus norvegicus
ttgcgttttctatcctcttctaaag

SEQ ID NO: 679507 - DNA, 25 bp, Rattus norvegicus
ttgctaaaatccatatggtggccag

SEQ ID NO: 679508 - DNA, 25 bp, Rattus norvegicus
ttgctaaaatccttatggtggccag

SEQ ID NO: 679509 - DNA, 25 bp, Rattus norvegicus
ttgctaaataaaactccccactcca

SEQ ID NO: 679510 - DNA, 25 bp, Rattus norvegicus
ttgctaaataaatctccccactcca

SEQ ID NO: 679511 - DNA, 25 bp, Rattus norvegicus
ttgctaacacttcgaaacctggctc

SEQ ID NO: 679512 - DNA, 25 bp, Rattus norvegicus
ttgctaacacttggaaacctggctc

SEQ ID NO: 679513 - DNA, 25 bp, Rattus norvegicus
ttgctaacctctaatagggctggct

SEQ ID NO: 679514 - DNA, 25 bp, Rattus norvegicus
ttgctaacctcttatagggctggct

SEQ ID NO: 679515 - DNA, 25 bp, Rattus norvegicus
ttgctaacgtggcagtttctttgat

SEQ ID NO: 679516 - DNA, 25 bp, Rattus norvegicus
ttgctaacgtgggagtttctttgat

SEQ ID NO: 679517 - DNA, 25 bp, Rattus norvegicus
ttgctaagccacagaaacctcattt

SEQ ID NO: 679518 - DNA, 25 bp, Rattus norvegicus
ttgctaagccactgaaacctcattt

SEQ ID NO: 679519 - DNA, 25 bp, Rattus norvegicus
ttgctaagctctcaaggtccctatt

SEQ ID NO: 679520 - DNA, 25 bp, Rattus norvegicus
ttgctaagctctgaaggtccctatt

SEQ ID NO: 679521 - DNA, 25 bp, Rattus norvegicus
ttgctaagtagccaaggacgacctt

SEQ ID NO: 679522 - DNA, 25 bp, Rattus norvegicus
ttgctaagtagcgaaggacgacctt

SEQ ID NO: 679523 - DNA, 25 bp, Rattus norvegicus
ttgctaagtgttcgtcagtgtaatg

SEQ ID NO: 679524 - DNA, 25 bp, Rattus norvegicus
ttgctaagtgttggtcagtgtaatg

SEQ ID NO: 679525 - DNA, 25 bp, Rattus norvegicus
ttgctaataactcaccactggactc

SEQ ID NO: 679526 - DNA, 25 bp, Rattus norvegicus
ttgctaataactgaccactggactc

SEQ ID NO: 679527 - DNA, 25 bp, Rattus norvegicus
ttgctaatatttcccaatctgaaga

SEQ ID NO: 679528 - DNA, 25 bp, Rattus norvegicus
ttgctaatatttgccaatctgaaga

SEQ ID NO: 679529 - DNA, 25 bp, Rattus norvegicus
ttgctaatgccaaaaccctgtgact

SEQ ID NO: 679530 - DNA, 25 bp, Rattus norvegicus
ttgctaatgccataaccctgtgact

SEQ ID NO: 679531 - DNA, 25 bp, Rattus norvegicus
ttgctaatgctaatctctgtgcctg

SEQ ID NO: 679532 - DNA, 25 bp, Rattus norvegicus
ttgctaatgctattctctgtgcctg

SEQ ID NO: 679533 - DNA, 25 bp, Rattus norvegicus
ttgctaattattatccccgaggact

SEQ ID NO: 679534 - DNA, 25 bp, Rattus norvegicus
ttgctaattattttccccgaggact

SEQ ID NO: 679535 - DNA, 25 bp, Rattus norvegicus
ttgctaattttactacactcttttg

SEQ ID NO: 679536 - DNA, 25 bp, Rattus norvegicus
ttgctaattttagtacactcttttg

SEQ ID NO: 679537 - DNA, 25 bp, Rattus norvegicus
ttgctacacatcctgctcaaggaac

SEQ ID NO: 679538 - DNA, 25 bp, Rattus norvegicus
ttgctacacatcgtgctcaaggaac

SEQ ID NO: 679539 - DNA, 25 bp, Rattus norvegicus
ttgctacactgacccttgggtgcag

SEQ ID NO: 679540 - DNA, 25 bp, Rattus norvegicus
ttgctacactgagccttgggtgcag

SEQ ID NO: 679541 - DNA, 25 bp, Rattus norvegicus
ttgctacagcagacttaataccatg

SEQ ID NO: 679542 - DNA, 25 bp, Rattus norvegicus
ttgctacagcagtcttaataccatg

SEQ ID NO: 679543 - DNA, 25 bp, Rattus norvegicus
ttgctacatcaaaaatttcctaaat

SEQ ID NO: 679544 - DNA, 25 bp, Rattus norvegicus
ttgctacatcaataatttcctaaat

SEQ ID NO: 679545 - DNA, 25 bp, Rattus norvegicus
ttgctaccaacactgctgaactgag

SEQ ID NO: 679546 - DNA, 25 bp, Rattus norvegicus
ttgctaccaacagtgctgaactgag

SEQ ID NO: 679547 - DNA, 25 bp, Rattus norvegicus
ttgctaccaaggacagaacacggat

SEQ ID NO: 679548 - DNA, 25 bp, Rattus norvegicus
ttgctaccaaggtcagaacacggat

SEQ ID NO: 679549 - DNA, 25 bp, Rattus norvegicus
ttgctaccagatccccacttttcat

SEQ ID NO: 679550 - DNA, 25 bp, Rattus norvegicus
ttgctaccagatgcccacttttcat

SEQ ID NO: 679551 - DNA, 25 bp, Rattus norvegicus
ttgctaccagcccatggcagtgttg

SEQ ID NO: 679552 - DNA, 25 bp, Rattus norvegicus
ttgctaccagccgatggcagtgttg

SEQ ID NO: 679553 - DNA, 25 bp, Rattus norvegicus
ttgctaccaggacccagtgtgacct

SEQ ID NO: 679554 - DNA, 25 bp, Rattus norvegicus
ttgctaccaggagccagtgtgacct

SEQ ID NO: 679555 - DNA, 25 bp, Rattus norvegicus
ttgctaccctgcctatgtattatga

SEQ ID NO: 679556 - DNA, 25 bp, Rattus norvegicus
ttgctaccctgcgtatgtattatga

SEQ ID NO: 679557 - DNA, 25 bp, Rattus norvegicus
ttgctacctacaagtgccatcttta

SEQ ID NO: 679558 - DNA, 25 bp, Rattus norvegicus
ttgctacctacatgtgccatcttta

SEQ ID NO: 679559 - DNA, 25 bp, Rattus norvegicus
ttgctacctgccagtccttgcttta

SEQ ID NO: 679560 - DNA, 25 bp, Rattus norvegicus
ttgctacctgcctgtccttgcttta

SEQ ID NO: 679561 - DNA, 25 bp, Rattus norvegicus
ttgctaccttgcaccattagactct

SEQ ID NO: 679562 - DNA, 25 bp, Rattus norvegicus
ttgctaccttgctccattagactct

SEQ ID NO: 679563 - DNA, 25 bp, Rattus norvegicus
ttgctacgaacgattccccattgtt

SEQ ID NO: 679564 - DNA, 25 bp, Rattus norvegicus
ttgctacgaacgtttccccattgtt

SEQ ID NO: 679565 - DNA, 25 bp, Rattus norvegicus
ttgctacgactcagaggtcagggtt

SEQ ID NO: 679566 - DNA, 25 bp, Rattus norvegicus
ttgctacgactctgaggtcagggtt

SEQ ID NO: 679567 - DNA, 25 bp, Rattus norvegicus
ttgctacgtgttctttcggacttta

SEQ ID NO: 679568 - DNA, 25 bp, Rattus norvegicus
ttgctacgtgttgtttcggacttta

SEQ ID NO: 679569 - DNA, 25 bp, Rattus norvegicus
ttgctactactaaaaaattgatgtt

SEQ ID NO: 679570 - DNA, 25 bp, Rattus norvegicus
ttgctactactataaaattgatgtt

SEQ ID NO: 679571 - DNA, 25 bp, Rattus norvegicus
ttgctactcactctgcaccgtaagc

SEQ ID NO: 679572 - DNA, 25 bp, Rattus norvegicus
ttgctactcactgtgcaccgtaagc

SEQ ID NO: 679573 - DNA, 25 bp, Rattus norvegicus
ttgctactcattaagacaagttcat

SEQ ID NO: 679574 - DNA, 25 bp, Rattus norvegicus
ttgctactcatttagacaagttcat

SEQ ID NO: 679575 - DNA, 25 bp, Rattus norvegicus
ttgctactgtctactccacaaaagt

SEQ ID NO: 679576 - DNA, 25 bp, Rattus norvegicus
ttgctactgtcttctccacaaaagt

SEQ ID NO: 679577 - DNA, 25 bp, Rattus norvegicus
ttgctactgtgaacttttacctcca

SEQ ID NO: 679578 - DNA, 25 bp, Rattus norvegicus
ttgctactgtgatcttttacctcca

SEQ ID NO: 679579 - DNA, 25 bp, Rattus norvegicus
ttgctacttcatactttggtactgt

SEQ ID NO: 679580 - DNA, 25 bp, Rattus norvegicus
ttgctacttcattctttggtactgt

SEQ ID NO: 679581 - DNA, 25 bp, Rattus norvegicus
ttgctactttgcagtattcgtgtgt

SEQ ID NO: 679582 - DNA, 25 bp, Rattus norvegicus
ttgctactttgctgtattcgtgtgt

SEQ ID NO: 679583 - DNA, 25 bp, Rattus norvegicus
ttgctagactctcattctgtttcct

SEQ ID NO: 679584 - DNA, 25 bp, Rattus norvegicus
ttgctagactctgattctgtttcct

SEQ ID NO: 679585 - DNA, 25 bp, Rattus norvegicus
ttgctagatgcgatctgggtgcttg

SEQ ID NO: 679586 - DNA, 25 bp, Rattus norvegicus
ttgctagatgcgttctgggtgcttg

SEQ ID NO: 679587 - DNA, 25 bp, Rattus norvegicus
ttgctagctgtcagcctcaggacaa

SEQ ID NO: 679588 - DNA, 25 bp, Rattus norvegicus
ttgctagctgtctgcctcaggacaa

SEQ ID NO: 679589 - DNA, 25 bp, Rattus norvegicus
ttgctaggaagcatggaaaactgta

SEQ ID NO: 679590 - DNA, 25 bp, Rattus norvegicus
ttgctaggaagcttggaaaactgta

SEQ ID NO: 679591 - DNA, 25 bp, Rattus norvegicus
ttgctagggtggatatgtttttgaa

SEQ ID NO: 679592 - DNA, 25 bp, Rattus norvegicus
ttgctagggtggttatgtttttgaa

SEQ ID NO: 679593 - DNA, 25 bp, Rattus norvegicus
ttgctagtgcttcagtttgtgtcta

SEQ ID NO: 679594 - DNA, 25 bp, Rattus norvegicus
ttgctagtgcttgagtttgtgtcta

SEQ ID NO: 679595 - DNA, 25 bp, Rattus norvegicus
ttgctagttcgtctggtgtctgcag

SEQ ID NO: 679596 - DNA, 25 bp, Rattus norvegicus
ttgctagttcgtgtggtgtctgcag

SEQ ID NO: 679597 - DNA, 25 bp, Rattus norvegicus
ttgctataaaggactcagcgcccct

SEQ ID NO: 679598 - DNA, 25 bp, Rattus norvegicus
ttgctataaaggtctcagcgcccct

SEQ ID NO: 679599 - DNA, 25 bp, Rattus norvegicus
ttgctataacctcccactggaaaaa

SEQ ID NO: 679600 - DNA, 25 bp, Rattus norvegicus
ttgctataacctgccactggaaaaa

SEQ ID NO: 679601 - DNA, 25 bp, Rattus norvegicus
ttgctataagttctataaggtgcat

SEQ ID NO: 679602 - DNA, 25 bp, Rattus norvegicus
ttgctataagttgtataaggtgcat

SEQ ID NO: 679603 - DNA, 25 bp, Rattus norvegicus
ttgctatatcttctggttttcttaa

SEQ ID NO: 679604 - DNA, 25 bp, Rattus norvegicus
ttgctatatcttgtggttttcttaa

SEQ ID NO: 679605 - DNA, 25 bp, Rattus norvegicus
ttgctatatgttatgggtctttttc

SEQ ID NO: 679606 - DNA, 25 bp, Rattus norvegicus
ttgctatatgttttgggtctttttc

SEQ ID NO: 679607 - DNA, 25 bp, Rattus norvegicus
ttgctatattgtctcaattttgctg

SEQ ID NO: 679608 - DNA, 25 bp, Rattus norvegicus
ttgctatattgtgtcaattttgctg

SEQ ID NO: 679609 - DNA, 25 bp, Rattus norvegicus
ttgctatcctcgatgtctctgaaaa

SEQ ID NO: 679610 - DNA, 25 bp, Rattus norvegicus
ttgctatcctcgttgtctctgaaaa

SEQ ID NO: 679611 - DNA, 25 bp, Rattus norvegicus
ttgctatcctgactgaaccggactg

SEQ ID NO: 679612 - DNA, 25 bp, Rattus norvegicus
ttgctatcctgagtgaaccggactg

SEQ ID NO: 679613 - DNA, 25 bp, Rattus norvegicus
ttgctatcttttaatgttcatctgt

SEQ ID NO: 679614 - DNA, 25 bp, Rattus norvegicus
ttgctatctttttatgttcatctgt

SEQ ID NO: 679615 - DNA, 25 bp, Rattus norvegicus
ttgctatgaggacctctgatgccct

SEQ ID NO: 679616 - DNA, 25 bp, Rattus norvegicus
ttgctatgaggagctctgatgccct

SEQ ID NO: 679617 - DNA, 25 bp, Rattus norvegicus
ttgctatgcgcaaggaactctcctg

SEQ ID NO: 679618 - DNA, 25 bp, Rattus norvegicus
ttgctatgcgcatggaactctcctg

SEQ ID NO: 679619 - DNA, 25 bp, Rattus norvegicus
ttgctatggatgacagagccagaga

SEQ ID NO: 679620 - DNA, 25 bp, Rattus norvegicus
ttgctatggatgtcagagccagaga

SEQ ID NO: 679621 - DNA, 25 bp, Rattus norvegicus
ttgctatgtgttaagctctgcctct

SEQ ID NO: 679622 - DNA, 25 bp, Rattus norvegicus
ttgctatgtgtttagctctgcctct

SEQ ID NO: 679623 - DNA, 25 bp, Rattus norvegicus
ttgctatgttatcctttctcttgta

SEQ ID NO: 679624 - DNA, 25 bp, Rattus norvegicus
ttgctatgttatgctttctcttgta

SEQ ID NO: 679625 - DNA, 25 bp, Rattus norvegicus
ttgctatgtttccagggccacatga

SEQ ID NO: 679626 - DNA, 25 bp, Rattus norvegicus
ttgctatgtttcgagggccacatga

SEQ ID NO: 679627 - DNA, 25 bp, Rattus norvegicus
ttgctattatccagtcctctctcca

SEQ ID NO: 679628 - DNA, 25 bp, Rattus norvegicus
ttgctattatcctgtcctctctcca

SEQ ID NO: 679629 - DNA, 25 bp, Rattus norvegicus
ttgctattccacattcaggacacac

SEQ ID NO: 679630 - DNA, 25 bp, Rattus norvegicus
ttgctattccactttcaggacacac

SEQ ID NO: 679631 - DNA, 25 bp, Rattus norvegicus
ttgctattccctcacttgatgttgt

SEQ ID NO: 679632 - DNA, 25 bp, Rattus norvegicus
ttgctattccctgacttgatgttgt

SEQ ID NO: 679633 - DNA, 25 bp, Rattus norvegicus
ttgctattgcgaatactgaccccta

SEQ ID NO: 679634 - DNA, 25 bp, Rattus norvegicus
ttgctattgcgattactgaccccta

SEQ ID NO: 679635 - DNA, 25 bp, Rattus norvegicus
ttgctatttttaatcctttggtaca

SEQ ID NO: 679636 - DNA, 25 bp, Rattus norvegicus
ttgctatttttattcctttggtaca

SEQ ID NO: 679637 - DNA, 25 bp, Rattus norvegicus
ttgctatttttgatttggccaacta

SEQ ID NO: 679638 - DNA, 25 bp, Rattus norvegicus
ttgctatttttgttttggccaacta

SEQ ID NO: 679639 - DNA, 25 bp, Rattus norvegicus
ttgctcaaaaatactcctgcggtgc

SEQ ID NO: 679640 - DNA, 25 bp, Rattus norvegicus
ttgctcaaaaattctcctgcggtgc

SEQ ID NO: 679641 - DNA, 25 bp, Rattus norvegicus
ttgctcaaacctcgccacctgaatt

SEQ ID NO: 679642 - DNA, 25 bp, Rattus norvegicus
ttgctcaaacctggccacctgaatt

SEQ ID NO: 679643 - DNA, 25 bp, Rattus norvegicus
ttgctcaactccaatattctgccag

SEQ ID NO: 679644 - DNA, 25 bp, Rattus norvegicus
ttgctcaactcctatattctgccag

SEQ ID NO: 679645 - DNA, 25 bp, Rattus norvegicus
ttgctcaactcgatgggtccttgca

SEQ ID NO: 679646 - DNA, 25 bp, Rattus norvegicus
ttgctcaactcgttgggtccttgca

SEQ ID NO: 679647 - DNA, 25 bp, Rattus norvegicus
ttgctcaataacacgactcatttgt

SEQ ID NO: 679648 - DNA, 25 bp, Rattus norvegicus
ttgctcaataactcgactcatttgt

SEQ ID NO: 679649 - DNA, 25 bp, Rattus norvegicus
ttgctcaatcaaaccccaacaaatg

SEQ ID NO: 679650 - DNA, 25 bp, Rattus norvegicus
ttgctcaatcaatccccaacaaatg

SEQ ID NO: 679651 - DNA, 25 bp, Rattus norvegicus
ttgctcacagctctcaagttgttgt

SEQ ID NO: 679652 - DNA, 25 bp, Rattus norvegicus
ttgctcacagctgtcaagttgttgt

SEQ ID NO: 679653 - DNA, 25 bp, Rattus norvegicus
ttgctcacccatctgtctgaaaacc

SEQ ID NO: 679654 - DNA, 25 bp, Rattus norvegicus
ttgctcacccatgtgtctgaaaacc

SEQ ID NO: 679655 - DNA, 25 bp, Rattus norvegicus
ttgctcacccggcatagtgcatgaa

SEQ ID NO: 679656 - DNA, 25 bp, Rattus norvegicus
ttgctcacccgggatagtgcatgaa

SEQ ID NO: 679657 - DNA, 25 bp, Rattus norvegicus
ttgctcaccctgattccagagaatg

SEQ ID NO: 679658 - DNA, 25 bp, Rattus norvegicus
ttgctcaccctgtttccagagaatg

SEQ ID NO: 679659 - DNA, 25 bp, Rattus norvegicus
ttgctcacctccagcaggaagaggg

SEQ ID NO: 679660 - DNA, 25 bp, Rattus norvegicus
ttgctcacctcctgcaggaagaggg

SEQ ID NO: 679661 - DNA, 25 bp, Rattus norvegicus
ttgctcacgaatcaaacggctctgt

SEQ ID NO: 679662 - DNA, 25 bp, Rattus norvegicus
ttgctcacgaatgaaacggctctgt

SEQ ID NO: 679663 - DNA, 25 bp, Rattus norvegicus
ttgctcactgaaccttcagtcacct

SEQ ID NO: 679664 - DNA, 25 bp, Rattus norvegicus
ttgctcactgaagcttcagtcacct

SEQ ID NO: 679665 - DNA, 25 bp, Rattus norvegicus
ttgctcactgcacttttgttaccgt

SEQ ID NO: 679666 - DNA, 25 bp, Rattus norvegicus
ttgctcactgcagttttgttaccgt

SEQ ID NO: 679667 - DNA, 25 bp, Rattus norvegicus
ttgctcactgtcactctgtccactc

SEQ ID NO: 679668 - DNA, 25 bp, Rattus norvegicus
ttgctcactgtctctctgtccactc

SEQ ID NO: 679669 - DNA, 25 bp, Rattus norvegicus
ttgctcagactcaaccaaggtttgt

SEQ ID NO: 679670 - DNA, 25 bp, Rattus norvegicus
ttgctcagactctaccaaggtttgt

SEQ ID NO: 679671 - DNA, 25 bp, Rattus norvegicus
ttgctcagatctacggttgggacct

SEQ ID NO: 679672 - DNA, 25 bp, Rattus norvegicus
ttgctcagatcttcggttgggacct

SEQ ID NO: 679673 - DNA, 25 bp, Rattus norvegicus
ttgctcagcagtactaccttgttta

SEQ ID NO: 679674 - DNA, 25 bp, Rattus norvegicus
ttgctcagcagttctaccttgttta

SEQ ID NO: 679675 - DNA, 25 bp, Rattus norvegicus
ttgctcagccctactgacttcaaaa

SEQ ID NO: 679676 - DNA, 25 bp, Rattus norvegicus
ttgctcagcccttctgacttcaaaa

SEQ ID NO: 679677 - DNA, 25 bp, Rattus norvegicus
ttgctcagcctcctggttgcaacag

SEQ ID NO: 679678 - DNA, 25 bp, Rattus norvegicus
ttgctcagcctcgtggttgcaacag

SEQ ID NO: 679679 - DNA, 25 bp, Rattus norvegicus
ttgctcagctgacagtctgcgtgga

SEQ ID NO: 679680 - DNA, 25 bp, Rattus norvegicus
ttgctcagctgagagtctgcgtgga

SEQ ID NO: 679681 - DNA, 25 bp, Rattus norvegicus
ttgctcagctgtctcataccgcaaa

SEQ ID NO: 679682 - DNA, 25 bp, Rattus norvegicus
ttgctcagctgtgtcataccgcaaa

SEQ ID NO: 679683 - DNA, 25 bp, Rattus norvegicus
ttgctcagggatagccttcgggttc

SEQ ID NO: 679684 - DNA, 25 bp, Rattus norvegicus
ttgctcagggattgccttcgggttc

SEQ ID NO: 679685 - DNA, 25 bp, Rattus norvegicus
ttgctcagtgcactaggatcctctc

SEQ ID NO: 679686 - DNA, 25 bp, Rattus norvegicus
ttgctcagtgcagtaggatcctctc

SEQ ID NO: 679687 - DNA, 25 bp, Rattus norvegicus
ttgctcatagcaagcctgtgggtag

SEQ ID NO: 679688 - DNA, 25 bp, Rattus norvegicus
ttgctcatagcatgcctgtgggtag

SEQ ID NO: 679689 - DNA, 25 bp, Rattus norvegicus
ttgctcatcaagatccaaccctgaa

SEQ ID NO: 679690 - DNA, 25 bp, Rattus norvegicus
ttgctcatcaagttccaaccctgaa

SEQ ID NO: 679691 - DNA, 25 bp, Rattus norvegicus
ttgctcatctccaaacgtggatccg

SEQ ID NO: 679692 - DNA, 25 bp, Rattus norvegicus
ttgctcatctcctaacgtggatccg

SEQ ID NO: 679693 - DNA, 25 bp, Rattus norvegicus
ttgctcatctctaactgtcacacta

SEQ ID NO: 679694 - DNA, 25 bp, Rattus norvegicus
ttgctcatctcttactgtcacacta

SEQ ID NO: 679695 - DNA, 25 bp, Rattus norvegicus
ttgctcatcttcatgaagcgtactg

SEQ ID NO: 679696 - DNA, 25 bp, Rattus norvegicus
ttgctcatcttcatgttggcagcgc

SEQ ID NO: 679697 - DNA, 25 bp, Rattus norvegicus
ttgctcatcttcttgaagcgtactg

SEQ ID NO: 679698 - DNA, 25 bp, Rattus norvegicus
ttgctcatcttcttgttggcagcgc

SEQ ID NO: 679699 - DNA, 25 bp, Rattus norvegicus
ttgctcatgaaaccataagcttctt

SEQ ID NO: 679700 - DNA, 25 bp, Rattus norvegicus
ttgctcatgaaagcataagcttctt

SEQ ID NO: 679701 - DNA, 25 bp, Rattus norvegicus
ttgctcatgctgaagctggaaactg

SEQ ID NO: 679702 - DNA, 25 bp, Rattus norvegicus
ttgctcatgctgtagctggaaactg

SEQ ID NO: 679703 - DNA, 25 bp, Rattus norvegicus
ttgctcatggcgagtgttcacagca

SEQ ID NO: 679704 - DNA, 25 bp, Rattus norvegicus
ttgctcatggcgtgtgttcacagca

SEQ ID NO: 679705 - DNA, 25 bp, Rattus norvegicus
ttgctccaagcaagtaatccttcag

SEQ ID NO: 679706 - DNA, 25 bp, Rattus norvegicus
ttgctccaagcatgtaatccttcag

SEQ ID NO: 679707 - DNA, 25 bp, Rattus norvegicus
ttgctccaagctcttgtatctgtga

SEQ ID NO: 679708 - DNA, 25 bp, Rattus norvegicus
ttgctccaagctgttgtatctgtga

SEQ ID NO: 679709 - DNA, 25 bp, Rattus norvegicus
ttgctccactgccatagttattgtc

SEQ ID NO: 679710 - DNA, 25 bp, Rattus norvegicus
ttgctccactgcgatagttattgtc

SEQ ID NO: 679711 - DNA, 25 bp, Rattus norvegicus
ttgctccactggcatttctttctat

SEQ ID NO: 679712 - DNA, 25 bp, Rattus norvegicus
ttgctccactgggatttctttctat

SEQ ID NO: 679713 - DNA, 25 bp, Rattus norvegicus
ttgctccacttccttaaaaccaaag

SEQ ID NO: 679714 - DNA, 25 bp, Rattus norvegicus
ttgctccacttcgttaaaaccaaag

SEQ ID NO: 679715 - DNA, 25 bp, Rattus norvegicus
ttgctccagggaagcagtccggttc

SEQ ID NO: 679716 - DNA, 25 bp, Rattus norvegicus
ttgctccagggatgcagtccggttc

SEQ ID NO: 679717 - DNA, 25 bp, Rattus norvegicus
ttgctccatgcacaaaacctaaaac

SEQ ID NO: 679718 - DNA, 25 bp, Rattus norvegicus
ttgctccatgcagaaaacctaaaac

SEQ ID NO: 679719 - DNA, 25 bp, Rattus norvegicus
ttgctcccaataccttttgaactgt

SEQ ID NO: 679720 - DNA, 25 bp, Rattus norvegicus
ttgctcccaatagcttttgaactgt

SEQ ID NO: 679721 - DNA, 25 bp, Rattus norvegicus
ttgctcccattgatctttagcactg

SEQ ID NO: 679722 - DNA, 25 bp, Rattus norvegicus
ttgctcccattgttctttagcactg

SEQ ID NO: 679723 - DNA, 25 bp, Rattus norvegicus
ttgctcccctctaaggaaaacaggc

SEQ ID NO: 679724 - DNA, 25 bp, Rattus norvegicus
ttgctcccctcttaggaaaacaggc

SEQ ID NO: 679725 - DNA, 25 bp, Rattus norvegicus
ttgctccgagttctttgtgactggc

SEQ ID NO: 679726 - DNA, 25 bp, Rattus norvegicus
ttgctccgagttgtttgtgactggc

SEQ ID NO: 679727 - DNA, 25 bp, Rattus norvegicus
ttgctccgcccgaaaactaatattt

SEQ ID NO: 679728 - DNA, 25 bp, Rattus norvegicus
ttgctccgcccgtaaactaatattt

SEQ ID NO: 679729 - DNA, 25 bp, Rattus norvegicus
ttgctccgctgtcggtgcagacaga

SEQ ID NO: 679730 - DNA, 25 bp, Rattus norvegicus
ttgctccgctgtgggtgcagacaga

SEQ ID NO: 679731 - DNA, 25 bp, Rattus norvegicus
ttgctcctataaaatccttcttcgt

SEQ ID NO: 679732 - DNA, 25 bp, Rattus norvegicus
ttgctcctataatatccttcttcgt

SEQ ID NO: 679733 - DNA, 25 bp, Rattus norvegicus
ttgctcctcattccctgacagtgca

SEQ ID NO: 679734 - DNA, 25 bp, Rattus norvegicus
ttgctcctcattgcctgacagtgca

SEQ ID NO: 679735 - DNA, 25 bp, Rattus norvegicus
ttgctcctccgtacgacattaagat

SEQ ID NO: 679736 - DNA, 25 bp, Rattus norvegicus
ttgctcctccgttcgacattaagat

SEQ ID NO: 679737 - DNA, 25 bp, Rattus norvegicus
ttgctcctgaaccatacagctgtgg

SEQ ID NO: 679738 - DNA, 25 bp, Rattus norvegicus
ttgctcctgaacgatacagctgtgg

SEQ ID NO: 679739 - DNA, 25 bp, Rattus norvegicus
ttgctcctgactctgaaacttgctt

SEQ ID NO: 679740 - DNA, 25 bp, Rattus norvegicus
ttgctcctgactgtgaaacttgctt

SEQ ID NO: 679741 - DNA, 25 bp, Rattus norvegicus
ttgctcctgccacctggtagaatgt

SEQ ID NO: 679742 - DNA, 25 bp, Rattus norvegicus
ttgctcctgccagctggtagaatgt

SEQ ID NO: 679743 - DNA, 25 bp, Rattus norvegicus
ttgctcctgtgtaaagatgccttgt

SEQ ID NO: 679744 - DNA, 25 bp, Rattus norvegicus
ttgctcctgtgttaagatgccttgt

SEQ ID NO: 679745 - DNA, 25 bp, Rattus norvegicus
ttgctccttacaatcagatttcctg

SEQ ID NO: 679746 - DNA, 25 bp, Rattus norvegicus
ttgctccttacattcagatttcctg

SEQ ID NO: 679747 - DNA, 25 bp, Rattus norvegicus
ttgctccttgttcttgaagcttcta

SEQ ID NO: 679748 - DNA, 25 bp, Rattus norvegicus
ttgctccttgttgttgaagcttcta

SEQ ID NO: 679749 - DNA, 25 bp, Rattus norvegicus
ttgctcctttctactctgaccaaaa

SEQ ID NO: 679750 - DNA, 25 bp, Rattus norvegicus
ttgctcctttcttctctgaccaaaa

SEQ ID NO: 679751 - DNA, 25 bp, Rattus norvegicus
ttgctcctttgccaagagtcaacaa

SEQ ID NO: 679752 - DNA, 25 bp, Rattus norvegicus
ttgctcctttgcgaagagtcaacaa

SEQ ID NO: 679753 - DNA, 25 bp, Rattus norvegicus
ttgctcgacgcaatgcccaggcaga

SEQ ID NO: 679754 - DNA, 25 bp, Rattus norvegicus
ttgctcgacgcattgcccaggcaga

SEQ ID NO: 679755 - DNA, 25 bp, Rattus norvegicus
ttgctcgagcttctgtctgagggac

SEQ ID NO: 679756 - DNA, 25 bp, Rattus norvegicus
ttgctcgagcttgtgtctgagggac

SEQ ID NO: 679757 - DNA, 25 bp, Rattus norvegicus
ttgctcgaggtcaggtcttgtcact

SEQ ID NO: 679758 - DNA, 25 bp, Rattus norvegicus
ttgctcgaggtctggtcttgtcact

SEQ ID NO: 679759 - DNA, 25 bp, Rattus norvegicus
ttgctcgcaccgcaaagtccattga

SEQ ID NO: 679760 - DNA, 25 bp, Rattus norvegicus
ttgctcgcaccggaaagtccattga

SEQ ID NO: 679761 - DNA, 25 bp, Rattus norvegicus
ttgctcgctctaacgcatttagaaa

SEQ ID NO: 679762 - DNA, 25 bp, Rattus norvegicus
ttgctcgctctatcgcatttagaaa

SEQ ID NO: 679763 - DNA, 25 bp, Rattus norvegicus
ttgctcggaaagattttgtagtacc

SEQ ID NO: 679764 - DNA, 25 bp, Rattus norvegicus
ttgctcggaaagtttttgtagtacc

SEQ ID NO: 679765 - DNA, 25 bp, Rattus norvegicus
ttgctcggactgctagtttcccaca

SEQ ID NO: 679766 - DNA, 25 bp, Rattus norvegicus
ttgctcggactggtagtttcccaca

SEQ ID NO: 679767 - DNA, 25 bp, Rattus norvegicus
ttgctcggcgttacggccttaagga

SEQ ID NO: 679768 - DNA, 25 bp, Rattus norvegicus
ttgctcggcgtttcggccttaagga

SEQ ID NO: 679769 - DNA, 25 bp, Rattus norvegicus
ttgctcgtcttcctgatcaagtgta

SEQ ID NO: 679770 - DNA, 25 bp, Rattus norvegicus
ttgctcgtcttcgtgatcaagtgta

SEQ ID NO: 679771 - DNA, 25 bp, Rattus norvegicus
ttgctcgtggagatgctcctgcaga

SEQ ID NO: 679772 - DNA, 25 bp, Rattus norvegicus
ttgctcgtggagttgctcctgcaga

SEQ ID NO: 679773 - DNA, 25 bp, Rattus norvegicus
ttgctctaaaccaggctgcataagc

SEQ ID NO: 679774 - DNA, 25 bp, Rattus norvegicus
ttgctctaaacctggctgcataagc

SEQ ID NO: 679775 - DNA, 25 bp, Rattus norvegicus
ttgctctatgagagaagtcctcttt

SEQ ID NO: 679776 - DNA, 25 bp, Rattus norvegicus
ttgctctatgagctctacacccata

SEQ ID NO: 679777 - DNA, 25 bp, Rattus norvegicus
ttgctctatgaggtctacacccata

SEQ ID NO: 679778 - DNA, 25 bp, Rattus norvegicus
ttgctctatgagtgaagtcctcttt

SEQ ID NO: 679779 - DNA, 25 bp, Rattus norvegicus
ttgctctatgtacacaatctgggta

SEQ ID NO: 679780 - DNA, 25 bp, Rattus norvegicus
ttgctctatgtagacaatctgggta

SEQ ID NO: 679781 - DNA, 25 bp, Rattus norvegicus
ttgctctcacctctcctcagaaaga

SEQ ID NO: 679782 - DNA, 25 bp, Rattus norvegicus
ttgctctcacctgtcctcagaaaga

SEQ ID NO: 679783 - DNA, 25 bp, Rattus norvegicus
ttgctctcagagctgttatttcacc

SEQ ID NO: 679784 - DNA, 25 bp, Rattus norvegicus
ttgctctcagaggtgttatttcacc

SEQ ID NO: 679785 - DNA, 25 bp, Rattus norvegicus
ttgctctcagcacatgcttcacata

SEQ ID NO: 679786 - DNA, 25 bp, Rattus norvegicus
ttgctctcagcagatgcttcacata

SEQ ID NO: 679787 - DNA, 25 bp, Rattus norvegicus
ttgctctcagccagtcacttttgaa

SEQ ID NO: 679788 - DNA, 25 bp, Rattus norvegicus
ttgctctcagcctgtcacttttgaa

SEQ ID NO: 679789 - DNA, 25 bp, Rattus norvegicus
ttgctctcaggtatacatctccctg

SEQ ID NO: 679790 - DNA, 25 bp, Rattus norvegicus
ttgctctcaggtttacatctccctg

SEQ ID NO: 679791 - DNA, 25 bp, Rattus norvegicus
ttgctctccagacgctcctaatgag

SEQ ID NO: 679792 - DNA, 25 bp, Rattus norvegicus
ttgctctccagaggctcctaatgag

SEQ ID NO: 679793 - DNA, 25 bp, Rattus norvegicus
ttgctctcccaaacctactgtagac

SEQ ID NO: 679794 - DNA, 25 bp, Rattus norvegicus
ttgctctcccaatcctactgtagac

SEQ ID NO: 679795 - DNA, 25 bp, Rattus norvegicus
ttgctctcccacagcttaagaggaa

SEQ ID NO: 679796 - DNA, 25 bp, Rattus norvegicus
ttgctctcccacaggaatctgtcat

SEQ ID NO: 679797 - DNA, 25 bp, Rattus norvegicus
ttgctctcccactgcttaagaggaa

SEQ ID NO: 679798 - DNA, 25 bp, Rattus norvegicus
ttgctctcccactggaatctgtcat

SEQ ID NO: 679799 - DNA, 25 bp, Rattus norvegicus
ttgctctccgaaaggcaacctggaa

SEQ ID NO: 679800 - DNA, 25 bp, Rattus norvegicus
ttgctctccgaatggcaacctggaa

SEQ ID NO: 679801 - DNA, 25 bp, Rattus norvegicus
ttgctctcctcaattgctcaggagt

SEQ ID NO: 679802 - DNA, 25 bp, Rattus norvegicus
ttgctctcctcatttgctcaggagt

SEQ ID NO: 679803 - DNA, 25 bp, Rattus norvegicus
ttgctctcgtttaggatgcatagac

SEQ ID NO: 679804 - DNA, 25 bp, Rattus norvegicus
ttgctctcgttttggatgcatagac

SEQ ID NO: 679805 - DNA, 25 bp, Rattus norvegicus
ttgctctctctacttcctgtgtgga

SEQ ID NO: 679806 - DNA, 25 bp, Rattus norvegicus
ttgctctctctagttcctgtgtgga

SEQ ID NO: 679807 - DNA, 25 bp, Rattus norvegicus
ttgctctctgctacttgttggtaga

SEQ ID NO: 679808 - DNA, 25 bp, Rattus norvegicus
ttgctctctgcttcttgttggtaga

SEQ ID NO: 679809 - DNA, 25 bp, Rattus norvegicus
ttgctctgagagcagttcagtattg

SEQ ID NO: 679810 - DNA, 25 bp, Rattus norvegicus
ttgctctgagaggagttcagtattg

SEQ ID NO: 679811 - DNA, 25 bp, Rattus norvegicus
ttgctctgcaccaatggctcggttg

SEQ ID NO: 679812 - DNA, 25 bp, Rattus norvegicus
ttgctctgcacctatggctcggttg

SEQ ID NO: 679813 - DNA, 25 bp, Rattus norvegicus
ttgctctgcgatatccgtcgcgcgc

SEQ ID NO: 679814 - DNA, 25 bp, Rattus norvegicus
ttgctctgcgatttccgtcgcgcgc

SEQ ID NO: 679815 - DNA, 25 bp, Rattus norvegicus
ttgctctgctgcacagatgggcttc

SEQ ID NO: 679816 - DNA, 25 bp, Rattus norvegicus
ttgctctgctgctcagatgggcttc

SEQ ID NO: 679817 - DNA, 25 bp, Rattus norvegicus
ttgctctggagtccttgatatgtaa

SEQ ID NO: 679818 - DNA, 25 bp, Rattus norvegicus
ttgctctggagtgcttgatatgtaa

SEQ ID NO: 679819 - DNA, 25 bp, Rattus norvegicus
ttgctctggcacatggatacctaca

SEQ ID NO: 679820 - DNA, 25 bp, Rattus norvegicus
ttgctctggcacttggatacctaca

SEQ ID NO: 679821 - DNA, 25 bp, Rattus norvegicus
ttgctctggcctccaaatgtcaatt

SEQ ID NO: 679822 - DNA, 25 bp, Rattus norvegicus
ttgctctggcctgcaaatgtcaatt

SEQ ID NO: 679823 - DNA, 25 bp, Rattus norvegicus
ttgctctgggctcttaatctgttag

SEQ ID NO: 679824 - DNA, 25 bp, Rattus norvegicus
ttgctctgggctgttaatctgttag

SEQ ID NO: 679825 - DNA, 25 bp, Rattus norvegicus
ttgctctgtagaaccagatggcctc

SEQ ID NO: 679826 - DNA, 25 bp, Rattus norvegicus
ttgctctgtagatccagatggcctc

SEQ ID NO: 679827 - DNA, 25 bp, Rattus norvegicus
ttgctctgtcagaagctgctaggcc

SEQ ID NO: 679828 - DNA, 25 bp, Rattus norvegicus
ttgctctgtcagtagctgctaggcc

SEQ ID NO: 679829 - DNA, 25 bp, Rattus norvegicus
ttgctctgtgcaactgctagcagta

SEQ ID NO: 679830 - DNA, 25 bp, Rattus norvegicus
ttgctctgtgcatctgctagcagta

SEQ ID NO: 679831 - DNA, 25 bp, Rattus norvegicus
ttgctcttagctaggatccttttga

SEQ ID NO: 679832 - DNA, 25 bp, Rattus norvegicus
ttgctcttagcttggatccttttga

SEQ ID NO: 679833 - DNA, 25 bp, Rattus norvegicus
ttgctcttatcccactatcagttca

SEQ ID NO: 679834 - DNA, 25 bp, Rattus norvegicus
ttgctcttatccgactatcagttca

SEQ ID NO: 679835 - DNA, 25 bp, Rattus norvegicus
ttgctcttcacccaagggcatagat

SEQ ID NO: 679836 - DNA, 25 bp, Rattus norvegicus
ttgctcttcaccgaagggcatagat

SEQ ID NO: 679837 - DNA, 25 bp, Rattus norvegicus
ttgctcttcactcacctcgatcagg

SEQ ID NO: 679838 - DNA, 25 bp, Rattus norvegicus
ttgctcttcactgacctcgatcagg

SEQ ID NO: 679839 - DNA, 25 bp, Rattus norvegicus
ttgctcttcccacccaaattcataa

SEQ ID NO: 679840 - DNA, 25 bp, Rattus norvegicus
ttgctcttcccagccaaattcataa

SEQ ID NO: 679841 - DNA, 25 bp, Rattus norvegicus
ttgctcttcctccatgatgttgacg

SEQ ID NO: 679842 - DNA, 25 bp, Rattus norvegicus
ttgctcttcctcgatgatgttgacg

SEQ ID NO: 679843 - DNA, 25 bp, Rattus norvegicus
ttgctcttctgtcaagccaagtgga

SEQ ID NO: 679844 - DNA, 25 bp, Rattus norvegicus
ttgctcttctgtgaagccaagtgga

SEQ ID NO: 679845 - DNA, 25 bp, Rattus norvegicus
ttgctcttcttaacctcaagaccag

SEQ ID NO: 679846 - DNA, 25 bp, Rattus norvegicus
ttgctcttcttaccttgaacatgaa

SEQ ID NO: 679847 - DNA, 25 bp, Rattus norvegicus
ttgctcttcttagcttgaacatgaa

SEQ ID NO: 679848 - DNA, 25 bp, Rattus norvegicus
ttgctcttcttatcctcaagaccag

SEQ ID NO: 679849 - DNA, 25 bp, Rattus norvegicus
ttgctctttaccctagctggtacca

SEQ ID NO: 679850 - DNA, 25 bp, Rattus norvegicus
ttgctctttaccgtagctggtacca

SEQ ID NO: 679851 - DNA, 25 bp, Rattus norvegicus
ttgctctttcttacttcacaggtat

SEQ ID NO: 679852 - DNA, 25 bp, Rattus norvegicus
ttgctctttctttcttcacaggtat

SEQ ID NO: 679853 - DNA, 25 bp, Rattus norvegicus
ttgctcttttgtatcaaactccaca

SEQ ID NO: 679854 - DNA, 25 bp, Rattus norvegicus
ttgctcttttgtttcaaactccaca

SEQ ID NO: 679855 - DNA, 25 bp, Rattus norvegicus
ttgctgaacactcatctgccaaaag

SEQ ID NO: 679856 - DNA, 25 bp, Rattus norvegicus
ttgctgaacactgatctgccaaaag

SEQ ID NO: 679857 - DNA, 25 bp, Rattus norvegicus
ttgctgaacatactatgcactctgg

SEQ ID NO: 679858 - DNA, 25 bp, Rattus norvegicus
ttgctgaacatagtatgcactctgg

SEQ ID NO: 679859 - DNA, 25 bp, Rattus norvegicus
ttgctgaacgtaaagattgaccctc

SEQ ID NO: 679860 - DNA, 25 bp, Rattus norvegicus
ttgctgaacgtatagattgaccctc

SEQ ID NO: 679861 - DNA, 25 bp, Rattus norvegicus
ttgctgaagcagagctctgagcctg

SEQ ID NO: 679862 - DNA, 25 bp, Rattus norvegicus
ttgctgaagcagtgctctgagcctg

SEQ ID NO: 679863 - DNA, 25 bp, Rattus norvegicus
ttgctgaagcctcggtataccctga

SEQ ID NO: 679864 - DNA, 25 bp, Rattus norvegicus
ttgctgaagcctgggtataccctga

SEQ ID NO: 679865 - DNA, 25 bp, Rattus norvegicus
ttgctgaaggacatggacctccttt

SEQ ID NO: 679866 - DNA, 25 bp, Rattus norvegicus
ttgctgaaggacttggacctccttt

SEQ ID NO: 679867 - DNA, 25 bp, Rattus norvegicus
ttgctgaaggcaaacactaaggatt

SEQ ID NO: 679868 - DNA, 25 bp, Rattus norvegicus
ttgctgaaggcatacactaaggatt

SEQ ID NO: 679869 - DNA, 25 bp, Rattus norvegicus
ttgctgaagtgcctgctctgaatga

SEQ ID NO: 679870 - DNA, 25 bp, Rattus norvegicus
ttgctgaagtgcgtgctctgaatga

SEQ ID NO: 679871 - DNA, 25 bp, Rattus norvegicus
ttgctgaatcagaagcttggtatca

SEQ ID NO: 679872 - DNA, 25 bp, Rattus norvegicus
ttgctgaatcagtagcttggtatca

SEQ ID NO: 679873 - DNA, 25 bp, Rattus norvegicus
ttgctgaatgtccttggccaagatt

SEQ ID NO: 679874 - DNA, 25 bp, Rattus norvegicus
ttgctgaatgtcgttggccaagatt

SEQ ID NO: 679875 - DNA, 25 bp, Rattus norvegicus
ttgctgacatctcttggcctaggtg

SEQ ID NO: 679876 - DNA, 25 bp, Rattus norvegicus
ttgctgacatctgttggcctaggtg

SEQ ID NO: 679877 - DNA, 25 bp, Rattus norvegicus
ttgctgacctcaaccattgacattg

SEQ ID NO: 679878 - DNA, 25 bp, Rattus norvegicus
ttgctgacctcatccattgacattg

SEQ ID NO: 679879 - DNA, 25 bp, Rattus norvegicus
ttgctgacttaacacacgggctgtt

SEQ ID NO: 679880 - DNA, 25 bp, Rattus norvegicus
ttgctgacttaagacacgggctgtt

SEQ ID NO: 679881 - DNA, 25 bp, Rattus norvegicus
ttgctgacttccacactagttttgg

SEQ ID NO: 679882 - DNA, 25 bp, Rattus norvegicus
ttgctgacttcctcactagttttgg

SEQ ID NO: 679883 - DNA, 25 bp, Rattus norvegicus
ttgctgagcaacaagaccttggcct

SEQ ID NO: 679884 - DNA, 25 bp, Rattus norvegicus
ttgctgagcaactagaccttggcct

SEQ ID NO: 679885 - DNA, 25 bp, Rattus norvegicus
ttgctgagccccagaattcaaacct

SEQ ID NO: 679886 - DNA, 25 bp, Rattus norvegicus
ttgctgagcccctgaattcaaacct

SEQ ID NO: 679887 - DNA, 25 bp, Rattus norvegicus
ttgctgagccttaaacatccatcac

SEQ ID NO: 679888 - DNA, 25 bp, Rattus norvegicus
ttgctgagcctttaacatccatcac

SEQ ID NO: 679889 - DNA, 25 bp, Rattus norvegicus
ttgctgagcgtgaacttggccaact

SEQ ID NO: 679890 - DNA, 25 bp, Rattus norvegicus
ttgctgagcgtgtacttggccaact

SEQ ID NO: 679891 - DNA, 25 bp, Rattus norvegicus
ttgctgagctgtattggaaccctgg

SEQ ID NO: 679892 - DNA, 25 bp, Rattus norvegicus
ttgctgagctgttttggaaccctgg

SEQ ID NO: 679893 - DNA, 25 bp, Rattus norvegicus
ttgctgagctttacgagtacaccca

SEQ ID NO: 679894 - DNA, 25 bp, Rattus norvegicus
ttgctgagcttttcgagtacaccca

SEQ ID NO: 679895 - DNA, 25 bp, Rattus norvegicus
ttgctgagggtaactggtgtgaatc

SEQ ID NO: 679896 - DNA, 25 bp, Rattus norvegicus
ttgctgagggtatctggtgtgaatc

SEQ ID NO: 679897 - DNA, 25 bp, Rattus norvegicus
ttgctgagtgcaagctagtgtcgtc

SEQ ID NO: 679898 - DNA, 25 bp, Rattus norvegicus
ttgctgagtgcatgctagtgtcgtc

SEQ ID NO: 679899 - DNA, 25 bp, Rattus norvegicus
ttgctgagtggtaggatccctccat

SEQ ID NO: 679900 - DNA, 25 bp, Rattus norvegicus
ttgctgagtggttggatccctccat

SEQ ID NO: 679901 - DNA, 25 bp, Rattus norvegicus
ttgctgatcagactagggcgaccac

SEQ ID NO: 679902 - DNA, 25 bp, Rattus norvegicus
ttgctgatcagagtagggcgaccac

SEQ ID NO: 679903 - DNA, 25 bp, Rattus norvegicus
ttgctgatctcaaacgggcgctgaa

SEQ ID NO: 679904 - DNA, 25 bp, Rattus norvegicus
ttgctgatctcatacgggcgctgaa

SEQ ID NO: 679905 - DNA, 25 bp, Rattus norvegicus
ttgctgatctggattatatcccctc

SEQ ID NO: 679906 - DNA, 25 bp, Rattus norvegicus
ttgctgatctggtttatatcccctc

SEQ ID NO: 679907 - DNA, 25 bp, Rattus norvegicus
ttgctgatgcccagaccaatgctgc

SEQ ID NO: 679908 - DNA, 25 bp, Rattus norvegicus
ttgctgatgccctgaccaatgctgc

SEQ ID NO: 679909 - DNA, 25 bp, Rattus norvegicus
ttgctgatgcctaccttgtaagaca

SEQ ID NO: 679910 - DNA, 25 bp, Rattus norvegicus
ttgctgatgccttccttgtaagaca

SEQ ID NO: 679911 - DNA, 25 bp, Rattus norvegicus
ttgctgatgtttatctgtctgagtc

SEQ ID NO: 679912 - DNA, 25 bp, Rattus norvegicus
ttgctgatgtttttctgtctgagtc

SEQ ID NO: 679913 - DNA, 25 bp, Rattus norvegicus
ttgctgattcctccacgagggtgga

SEQ ID NO: 679914 - DNA, 25 bp, Rattus norvegicus
ttgctgattcctgcacgagggtgga

SEQ ID NO: 679915 - DNA, 25 bp, Rattus norvegicus
ttgctgattctcatgggaccatctc

SEQ ID NO: 679916 - DNA, 25 bp, Rattus norvegicus
ttgctgattctcttgggaccatctc

SEQ ID NO: 679917 - DNA, 25 bp, Rattus norvegicus
ttgctgattgcaaccaaccttttgt

SEQ ID NO: 679918 - DNA, 25 bp, Rattus norvegicus
ttgctgattgcatccaaccttttgt

SEQ ID NO: 679919 - DNA, 25 bp, Rattus norvegicus
ttgctgcaaagcactgttcactcag

SEQ ID NO: 679920 - DNA, 25 bp, Rattus norvegicus
ttgctgcaaagctctgttcactcag

SEQ ID NO: 679921 - DNA, 25 bp, Rattus norvegicus
ttgctgcacatgctggtaatccccg

SEQ ID NO: 679922 - DNA, 25 bp, Rattus norvegicus
ttgctgcacatggtggtaatccccg

SEQ ID NO: 679923 - DNA, 25 bp, Rattus norvegicus
ttgctgcagacgctacctgtcatga

SEQ ID NO: 679924 - DNA, 25 bp, Rattus norvegicus
ttgctgcagacggtacctgtcatga

SEQ ID NO: 679925 - DNA, 25 bp, Rattus norvegicus
ttgctgcagcgaatcacgcacaggt

SEQ ID NO: 679926 - DNA, 25 bp, Rattus norvegicus
ttgctgcagcgattcacgcacaggt

SEQ ID NO: 679927 - DNA, 25 bp, Rattus norvegicus
ttgctgcagctcctctgactgtgaa

SEQ ID NO: 679928 - DNA, 25 bp, Rattus norvegicus
ttgctgcagctcgtctgactgtgaa

SEQ ID NO: 679929 - DNA, 25 bp, Rattus norvegicus
ttgctgcagggcacagttctaggcg

SEQ ID NO: 679930 - DNA, 25 bp, Rattus norvegicus
ttgctgcagggctcagttctaggcg

SEQ ID NO: 679931 - DNA, 25 bp, Rattus norvegicus
ttgctgcagtccaacaaagacctgt

SEQ ID NO: 679932 - DNA, 25 bp, Rattus norvegicus
ttgctgcagtcctacaaagacctgt

SEQ ID NO: 679933 - DNA, 25 bp, Rattus norvegicus
ttgctgcagtctaggtacttccgta

SEQ ID NO: 679934 - DNA, 25 bp, Rattus norvegicus
ttgctgcagtcttggtacttccgta

SEQ ID NO: 679935 - DNA, 25 bp, Rattus norvegicus
ttgctgcatggcacttttatggcat

SEQ ID NO: 679936 - DNA, 25 bp, Rattus norvegicus
ttgctgcatggctcttttatggcat

SEQ ID NO: 679937 - DNA, 25 bp, Rattus norvegicus
ttgctgccaactagagctctccaat

SEQ ID NO: 679938 - DNA, 25 bp, Rattus norvegicus
ttgctgccaacttgagctctccaat

SEQ ID NO: 679939 - DNA, 25 bp, Rattus norvegicus
ttgctgccaaggcaaggaggagctt

SEQ ID NO: 679940 - DNA, 25 bp, Rattus norvegicus
ttgctgccaagggaaggaggagctt

SEQ ID NO: 679941 - DNA, 25 bp, Rattus norvegicus
ttgctgccacacagacctctctgga

SEQ ID NO: 679942 - DNA, 25 bp, Rattus norvegicus
ttgctgccacacaggacgacttaaa

SEQ ID NO: 679943 - DNA, 25 bp, Rattus norvegicus
ttgctgccacactgacctctctgga

SEQ ID NO: 679944 - DNA, 25 bp, Rattus norvegicus
ttgctgccacactggacgacttaaa

SEQ ID NO: 679945 - DNA, 25 bp, Rattus norvegicus
ttgctgccacagaagcggccgagga

SEQ ID NO: 679946 - DNA, 25 bp, Rattus norvegicus
ttgctgccacagtagcggccgagga

SEQ ID NO: 679947 - DNA, 25 bp, Rattus norvegicus
ttgctgccatggctcctctaaagat

SEQ ID NO: 679948 - DNA, 25 bp, Rattus norvegicus
ttgctgccatgggtcctctaaagat

SEQ ID NO: 679949 - DNA, 25 bp, Rattus norvegicus
ttgctgcccattagtgtaattctca

SEQ ID NO: 679950 - DNA, 25 bp, Rattus norvegicus
ttgctgcccatttgtgtaattctca

SEQ ID NO: 679951 - DNA, 25 bp, Rattus norvegicus
ttgctgcccctacgaagctgaagct

SEQ ID NO: 679952 - DNA, 25 bp, Rattus norvegicus
ttgctgcccctaggaagctgaagct

SEQ ID NO: 679953 - DNA, 25 bp, Rattus norvegicus
ttgctgcccggcaaagacggtacaa

SEQ ID NO: 679954 - DNA, 25 bp, Rattus norvegicus
ttgctgcccggctaagacggtacaa

SEQ ID NO: 679955 - DNA, 25 bp, Rattus norvegicus
ttgctgcctactagcctgaatggga

SEQ ID NO: 679956 - DNA, 25 bp, Rattus norvegicus
ttgctgcctacttgcctgaatggga

SEQ ID NO: 679957 - DNA, 25 bp, Rattus norvegicus
ttgctgcctcatcagagacttcatg

SEQ ID NO: 679958 - DNA, 25 bp, Rattus norvegicus
ttgctgcctcatgagagacttcatg

SEQ ID NO: 679959 - DNA, 25 bp, Rattus norvegicus
ttgctgcctccgagtccagaaagga

SEQ ID NO: 679960 - DNA, 25 bp, Rattus norvegicus
ttgctgcctccgtgtccagaaagga

SEQ ID NO: 679961 - DNA, 25 bp, Rattus norvegicus
ttgctgcctttcagtaccatttaac

SEQ ID NO: 679962 - DNA, 25 bp, Rattus norvegicus
ttgctgcctttctgtaccatttaac

SEQ ID NO: 679963 - DNA, 25 bp, Rattus norvegicus
ttgctgcctttgctgtgttgactgt

SEQ ID NO: 679964 - DNA, 25 bp, Rattus norvegicus
ttgctgcctttggtgtgttgactgt

SEQ ID NO: 679965 - DNA, 25 bp, Rattus norvegicus
ttgctgcgggccataggaggactat

SEQ ID NO: 679966 - DNA, 25 bp, Rattus norvegicus
ttgctgcgggccttaggaggactat

SEQ ID NO: 679967 - DNA, 25 bp, Rattus norvegicus
ttgctgcgggctccccttaaagaga

SEQ ID NO: 679968 - DNA, 25 bp, Rattus norvegicus
ttgctgcgggctgcccttaaagaga

SEQ ID NO: 679969 - DNA, 25 bp, Rattus norvegicus
ttgctgcgtaccacacaaggcacca

SEQ ID NO: 679970 - DNA, 25 bp, Rattus norvegicus
ttgctgcgtacctcacaaggcacca

SEQ ID NO: 679971 - DNA, 25 bp, Rattus norvegicus
ttgctgctacgtcttggtgtatgta

SEQ ID NO: 679972 - DNA, 25 bp, Rattus norvegicus
ttgctgctacgtgttggtgtatgta

SEQ ID NO: 679973 - DNA, 25 bp, Rattus norvegicus
ttgctgctagcccttgtcaagtgtg

SEQ ID NO: 679974 - DNA, 25 bp, Rattus norvegicus
ttgctgctagccgttgtcaagtgtg

SEQ ID NO: 679975 - DNA, 25 bp, Rattus norvegicus
ttgctgctatagacataagagccag

SEQ ID NO: 679976 - DNA, 25 bp, Rattus norvegicus
ttgctgctatagtcataagagccag

SEQ ID NO: 679977 - DNA, 25 bp, Rattus norvegicus
ttgctgctccagatgtagacatttt

SEQ ID NO: 679978 - DNA, 25 bp, Rattus norvegicus
ttgctgctccagttgtagacatttt

SEQ ID NO: 679979 - DNA, 25 bp, Rattus norvegicus
ttgctgctcgatcttctttgatgga

SEQ ID NO: 679980 - DNA, 25 bp, Rattus norvegicus
ttgctgctcgatgttctttgatgga

SEQ ID NO: 679981 - DNA, 25 bp, Rattus norvegicus
ttgctgctctatccaggtgcagtgt

SEQ ID NO: 679982 - DNA, 25 bp, Rattus norvegicus
ttgctgctctatgcaggtgcagtgt

SEQ ID NO: 679983 - DNA, 25 bp, Rattus norvegicus
ttgctgctctcgctcctattgagcg

SEQ ID NO: 679984 - DNA, 25 bp, Rattus norvegicus
ttgctgctctcggtcctattgagcg

SEQ ID NO: 679985 - DNA, 25 bp, Rattus norvegicus
ttgctgctcttgacattctgggcag

SEQ ID NO: 679986 - DNA, 25 bp, Rattus norvegicus
ttgctgctcttgtcattctgggcag

SEQ ID NO: 679987 - DNA, 25 bp, Rattus norvegicus
ttgctgctgagaaagggccattacc

SEQ ID NO: 679988 - DNA, 25 bp, Rattus norvegicus
ttgctgctgagatagggccattacc

SEQ ID NO: 679989 - DNA, 25 bp, Rattus norvegicus
ttgctgctgcagaaggtcatgttga

SEQ ID NO: 679990 - DNA, 25 bp, Rattus norvegicus
ttgctgctgcagtaggtcatgttga

SEQ ID NO: 679991 - DNA, 25 bp, Rattus norvegicus
ttgctgctgcccataagtttggtgc

SEQ ID NO: 679992 - DNA, 25 bp, Rattus norvegicus
ttgctgctgcccttaagtttggtgc

SEQ ID NO: 679993 - DNA, 25 bp, Rattus norvegicus
ttgctgctgcctataagtttggcgt

SEQ ID NO: 679994 - DNA, 25 bp, Rattus norvegicus
ttgctgctgcctttaagtttggcgt

SEQ ID NO: 679995 - DNA, 25 bp, Rattus norvegicus
ttgctgctgctgagttaaaataatt

SEQ ID NO: 679996 - DNA, 25 bp, Rattus norvegicus
ttgctgctgctgatggtttattcta

SEQ ID NO: 679997 - DNA, 25 bp, Rattus norvegicus
ttgctgctgctgtgttaaaataatt

SEQ ID NO: 679998 - DNA, 25 bp, Rattus norvegicus
ttgctgctgctgttggtttattcta

SEQ ID NO: 679999 - DNA, 25 bp, Rattus norvegicus
ttgctgctgcttcagcgctgagaaa

SEQ ID NO: 680000 - DNA, 25 bp, Rattus norvegicus
ttgctgctgcttgagcgctgagaaa

SEQ ID NO: 680001 - DNA, 25 bp, Rattus norvegicus
ttgctgctggagacccttagctgac

SEQ ID NO: 680002 - DNA, 25 bp, Rattus norvegicus
ttgctgctggagtcccttagctgac

SEQ ID NO: 680003 - DNA, 25 bp, Rattus norvegicus
ttgctgctggctctcaacatagcga

SEQ ID NO: 680004 - DNA, 25 bp, Rattus norvegicus
ttgctgctggctgtcaacatagcga

SEQ ID NO: 680005 - DNA, 25 bp, Rattus norvegicus
ttgctgctgggtctggttacctgaa

SEQ ID NO: 680006 - DNA, 25 bp, Rattus norvegicus
ttgctgctgggtgtggttacctgaa

SEQ ID NO: 680007 - DNA, 25 bp, Rattus norvegicus
ttgctgctgtcactctacaaagtca

SEQ ID NO: 680008 - DNA, 25 bp, Rattus norvegicus
ttgctgctgtcagtctacaaagtca

SEQ ID NO: 680009 - DNA, 25 bp, Rattus norvegicus
ttgctgctgtgccttcagggactga

SEQ ID NO: 680010 - DNA, 25 bp, Rattus norvegicus
ttgctgctgtgcgttcagggactga

SEQ ID NO: 680011 - DNA, 25 bp, Rattus norvegicus
ttgctgctgtggcaacttgcatatg

SEQ ID NO: 680012 - DNA, 25 bp, Rattus norvegicus
ttgctgctgtgggaacttgcatatg

SEQ ID NO: 680013 - DNA, 25 bp, Rattus norvegicus
ttgctgcttgctcttttgtttcaaa

SEQ ID NO: 680014 - DNA, 25 bp, Rattus norvegicus
ttgctgcttgctgttttgtttcaaa

SEQ ID NO: 680015 - DNA, 25 bp, Rattus norvegicus
ttgctggaatttccctgcgcccaca

SEQ ID NO: 680016 - DNA, 25 bp, Rattus norvegicus
ttgctggaatttgcctgcgcccaca

SEQ ID NO: 680017 - DNA, 25 bp, Rattus norvegicus
ttgctggacaaccaagactgcctgt

SEQ ID NO: 680018 - DNA, 25 bp, Rattus norvegicus
ttgctggacaacgaagactgcctgt

SEQ ID NO: 680019 - DNA, 25 bp, Rattus norvegicus
ttgctggacagcaagtggctcccac

SEQ ID NO: 680020 - DNA, 25 bp, Rattus norvegicus
ttgctggacagctagtggctcccac

SEQ ID NO: 680021 - DNA, 25 bp, Rattus norvegicus
ttgctggaccagctgaaccacacag

SEQ ID NO: 680022 - DNA, 25 bp, Rattus norvegicus
ttgctggaccagctgctgcagaaaa

SEQ ID NO: 680023 - DNA, 25 bp, Rattus norvegicus
ttgctggaccaggtgaaccacacag

SEQ ID NO: 680024 - DNA, 25 bp, Rattus norvegicus
ttgctggaccaggtgctgcagaaaa

SEQ ID NO: 680025 - DNA, 25 bp, Rattus norvegicus
ttgctggacgttcggcctcaagtag

SEQ ID NO: 680026 - DNA, 25 bp, Rattus norvegicus
ttgctggacgttgggcctcaagtag

SEQ ID NO: 680027 - DNA, 25 bp, Rattus norvegicus
ttgctggactttctagccccatcaa

SEQ ID NO: 680028 - DNA, 25 bp, Rattus norvegicus
ttgctggactttgtagccccatcaa

SEQ ID NO: 680029 - DNA, 25 bp, Rattus norvegicus
ttgctggagtccctgagttaagtca

SEQ ID NO: 680030 - DNA, 25 bp, Rattus norvegicus
ttgctggagtccgtgagttaagtca

SEQ ID NO: 680031 - DNA, 25 bp, Rattus norvegicus
ttgctggagtctaggcgtttctggc

SEQ ID NO: 680032 - DNA, 25 bp, Rattus norvegicus
ttgctggagtcttggcgtttctggc

SEQ ID NO: 680033 - DNA, 25 bp, Rattus norvegicus
ttgctggatgaacggtgactctgat

SEQ ID NO: 680034 - DNA, 25 bp, Rattus norvegicus
ttgctggatgaagggtgactctgat

SEQ ID NO: 680035 - DNA, 25 bp, Rattus norvegicus
ttgctggcagccataggtcctgagc

SEQ ID NO: 680036 - DNA, 25 bp, Rattus norvegicus
ttgctggcagccttaggtcctgagc

SEQ ID NO: 680037 - DNA, 25 bp, Rattus norvegicus
ttgctggccagcagttcttcaacgg

SEQ ID NO: 680038 - DNA, 25 bp, Rattus norvegicus
ttgctggccagctgttcttcaacgg

SEQ ID NO: 680039 - DNA, 25 bp, Rattus norvegicus
ttgctggcccatattaaactttaag

SEQ ID NO: 680040 - DNA, 25 bp, Rattus norvegicus
ttgctggcccattttaaactttaag

SEQ ID NO: 680041 - DNA, 25 bp, Rattus norvegicus
ttgctggcctgaccgtggacttgat

SEQ ID NO: 680042 - DNA, 25 bp, Rattus norvegicus
ttgctggcctgagcgtggacttgat

SEQ ID NO: 680043 - DNA, 25 bp, Rattus norvegicus
ttgctggccttcaggctgacctggc

SEQ ID NO: 680044 - DNA, 25 bp, Rattus norvegicus
ttgctggccttctggctgacctggc

SEQ ID NO: 680045 - DNA, 25 bp, Rattus norvegicus
ttgctggcgcgaagctgtgaacgtc

SEQ ID NO: 680046 - DNA, 25 bp, Rattus norvegicus
ttgctggcgcgatgctgtgaacgtc

SEQ ID NO: 680047 - DNA, 25 bp, Rattus norvegicus
ttgctggctccacaaagggtgtcct

SEQ ID NO: 680048 - DNA, 25 bp, Rattus norvegicus
ttgctggctccagaaagggtgtcct

SEQ ID NO: 680049 - DNA, 25 bp, Rattus norvegicus
ttgctggctctaagggaaactattt

SEQ ID NO: 680050 - DNA, 25 bp, Rattus norvegicus
ttgctggctctatgggaaactattt

SEQ ID NO: 680051 - DNA, 25 bp, Rattus norvegicus
ttgctggctgcaagaattgatcaca

SEQ ID NO: 680052 - DNA, 25 bp, Rattus norvegicus
ttgctggctgcatgaattgatcaca

SEQ ID NO: 680053 - DNA, 25 bp, Rattus norvegicus
ttgctgggatgaaaccgtaccggac

SEQ ID NO: 680054 - DNA, 25 bp, Rattus norvegicus
ttgctgggatgataccgtaccggac

SEQ ID NO: 680055 - DNA, 25 bp, Rattus norvegicus
ttgctgggcaacaatttaggatctg

SEQ ID NO: 680056 - DNA, 25 bp, Rattus norvegicus
ttgctgggcaactatttaggatctg

SEQ ID NO: 680057 - DNA, 25 bp, Rattus norvegicus
ttgctgggcagactaccatctccat

SEQ ID NO: 680058 - DNA, 25 bp, Rattus norvegicus
ttgctgggcagagtaccatctccat

SEQ ID NO: 680059 - DNA, 25 bp, Rattus norvegicus
ttgctgggtctgaaggcctacctct

SEQ ID NO: 680060 - DNA, 25 bp, Rattus norvegicus
ttgctgggtctgtaggcctacctct

SEQ ID NO: 680061 - DNA, 25 bp, Rattus norvegicus
ttgctggtcaagagatctggctaca

SEQ ID NO: 680062 - DNA, 25 bp, Rattus norvegicus
ttgctggtcaagtgatctggctaca

SEQ ID NO: 680063 - DNA, 25 bp, Rattus norvegicus
ttgctggtctgcagcagatgagcca

SEQ ID NO: 680064 - DNA, 25 bp, Rattus norvegicus
ttgctggtctgctgcagatgagcca

SEQ ID NO: 680065 - DNA, 25 bp, Rattus norvegicus
ttgctggtgaccatgccctgaaaga

SEQ ID NO: 680066 - DNA, 25 bp, Rattus norvegicus
ttgctggtgaccttgccctgaaaga

SEQ ID NO: 680067 - DNA, 25 bp, Rattus norvegicus
ttgctggtgtgtaactgatccttaa

SEQ ID NO: 680068 - DNA, 25 bp, Rattus norvegicus
ttgctggtgtgttactgatccttaa

SEQ ID NO: 680069 - DNA, 25 bp, Rattus norvegicus
ttgctggttcttatttactcaagcc

SEQ ID NO: 680070 - DNA, 25 bp, Rattus norvegicus
ttgctggttcttttttactcaagcc

SEQ ID NO: 680071 - DNA, 25 bp, Rattus norvegicus
ttgctggttggcacaggcagtactg

SEQ ID NO: 680072 - DNA, 25 bp, Rattus norvegicus
ttgctggttggctcaggcagtactg

SEQ ID NO: 680073 - DNA, 25 bp, Rattus norvegicus
ttgctggtttttagtgagttttaat

SEQ ID NO: 680074 - DNA, 25 bp, Rattus norvegicus
ttgctggttttttgtgagttttaat

SEQ ID NO: 680075 - DNA, 25 bp, Rattus norvegicus
ttgctgtaactaccttgctttctac

SEQ ID NO: 680076 - DNA, 25 bp, Rattus norvegicus
ttgctgtaactagcttgctttctac

SEQ ID NO: 680077 - DNA, 25 bp, Rattus norvegicus
ttgctgtaccagagccatctatgaa

SEQ ID NO: 680078 - DNA, 25 bp, Rattus norvegicus
ttgctgtaccagtgccatctatgaa

SEQ ID NO: 680079 - DNA, 25 bp, Rattus norvegicus
ttgctgtacccacgttgttgaactt

SEQ ID NO: 680080 - DNA, 25 bp, Rattus norvegicus
ttgctgtacccaggttgttgaactt

SEQ ID NO: 680081 - DNA, 25 bp, Rattus norvegicus
ttgctgtaccggactgaaatcctga

SEQ ID NO: 680082 - DNA, 25 bp, Rattus norvegicus
ttgctgtaccggtctgaaatcctga

SEQ ID NO: 680083 - DNA, 25 bp, Rattus norvegicus
ttgctgtacctgaacccaccagtga

SEQ ID NO: 680084 - DNA, 25 bp, Rattus norvegicus
ttgctgtacctgtacccaccagtga

SEQ ID NO: 680085 - DNA, 25 bp, Rattus norvegicus
ttgctgtactcccaggtagtcagag

SEQ ID NO: 680086 - DNA, 25 bp, Rattus norvegicus
ttgctgtactccgaggtagtcagag

SEQ ID NO: 680087 - DNA, 25 bp, Rattus norvegicus
ttgctgtagcagcttcactagaaca

SEQ ID NO: 680088 - DNA, 25 bp, Rattus norvegicus
ttgctgtagcaggttcactagaaca

SEQ ID NO: 680089 - DNA, 25 bp, Rattus norvegicus
ttgctgtagcggaccgcagagaccg

SEQ ID NO: 680090 - DNA, 25 bp, Rattus norvegicus
ttgctgtagcggtccgcagagaccg

SEQ ID NO: 680091 - DNA, 25 bp, Rattus norvegicus
ttgctgtcacatctgaagcctggtc

SEQ ID NO: 680092 - DNA, 25 bp, Rattus norvegicus
ttgctgtcacatgtgaagcctggtc

SEQ ID NO: 680093 - DNA, 25 bp, Rattus norvegicus
ttgctgtcagatccgcatccaagaa

SEQ ID NO: 680094 - DNA, 25 bp, Rattus norvegicus
ttgctgtcagatgcgcatccaagaa

SEQ ID NO: 680095 - DNA, 25 bp, Rattus norvegicus
ttgctgtccaccattaccttgggtg

SEQ ID NO: 680096 - DNA, 25 bp, Rattus norvegicus
ttgctgtccacctttaccttgggtg

SEQ ID NO: 680097 - DNA, 25 bp, Rattus norvegicus
ttgctgtccagaactgtagtccctt

SEQ ID NO: 680098 - DNA, 25 bp, Rattus norvegicus
ttgctgtccagatctgtagtccctt

SEQ ID NO: 680099 - DNA, 25 bp, Rattus norvegicus
ttgctgtcccttctcatatggccag

SEQ ID NO: 680100 - DNA, 25 bp, Rattus norvegicus
ttgctgtcccttgtcatatggccag

SEQ ID NO: 680101 - DNA, 25 bp, Rattus norvegicus
ttgctgtccgtaaaccttgtttggg

SEQ ID NO: 680102 - DNA, 25 bp, Rattus norvegicus
ttgctgtccgtataccttgtttggg

SEQ ID NO: 680103 - DNA, 25 bp, Rattus norvegicus
ttgctgtcctggcttgttggcgaac

SEQ ID NO: 680104 - DNA, 25 bp, Rattus norvegicus
ttgctgtcctgggttgttggcgaac

SEQ ID NO: 680105 - DNA, 25 bp, Rattus norvegicus
ttgctgtctcctagaactgctgaag

SEQ ID NO: 680106 - DNA, 25 bp, Rattus norvegicus
ttgctgtctccttgaactgctgaag

SEQ ID NO: 680107 - DNA, 25 bp, Rattus norvegicus
ttgctgtctcttagttttgtctcct

SEQ ID NO: 680108 - DNA, 25 bp, Rattus norvegicus
ttgctgtctctttgttttgtctcct

SEQ ID NO: 680109 - DNA, 25 bp, Rattus norvegicus
ttgctgtctgttaggtgctagtaaa

SEQ ID NO: 680110 - DNA, 25 bp, Rattus norvegicus
ttgctgtctgtttggtgctagtaaa

SEQ ID NO: 680111 - DNA, 25 bp, Rattus norvegicus
ttgctgtcttgtctgttcttttaaa

SEQ ID NO: 680112 - DNA, 25 bp, Rattus norvegicus
ttgctgtcttgtgtgttcttttaaa

SEQ ID NO: 680113 - DNA, 25 bp, Rattus norvegicus
ttgctgtctttcctgcaaatgtctc

SEQ ID NO: 680114 - DNA, 25 bp, Rattus norvegicus
ttgctgtctttcgtgcaaatgtctc

SEQ ID NO: 680115 - DNA, 25 bp, Rattus norvegicus
ttgctgtgaaaaaccctaccagtgg

SEQ ID NO: 680116 - DNA, 25 bp, Rattus norvegicus
ttgctgtgaaaatccctaccagtgg

SEQ ID NO: 680117 - DNA, 25 bp, Rattus norvegicus
ttgctgtgaacacctgcatctctga

SEQ ID NO: 680118 - DNA, 25 bp, Rattus norvegicus
ttgctgtgaacagctgcatctctga

SEQ ID NO: 680119 - DNA, 25 bp, Rattus norvegicus
ttgctgtgaactaacccacatcttg

SEQ ID NO: 680120 - DNA, 25 bp, Rattus norvegicus
ttgctgtgaacttacccacatcttg

SEQ ID NO: 680121 - DNA, 25 bp, Rattus norvegicus
ttgctgtgaagtcatccaaaaacga

SEQ ID NO: 680122 - DNA, 25 bp, Rattus norvegicus
ttgctgtgaagtgatccaaaaacga

SEQ ID NO: 680123 - DNA, 25 bp, Rattus norvegicus
ttgctgtgattcctggtggctcatc

SEQ ID NO: 680124 - DNA, 25 bp, Rattus norvegicus
ttgctgtgattcgtggtggctcatc

SEQ ID NO: 680125 - DNA, 25 bp, Rattus norvegicus
ttgctgtgcgttagaggccacccta

SEQ ID NO: 680126 - DNA, 25 bp, Rattus norvegicus
ttgctgtgcgtttgaggccacccta

SEQ ID NO: 680127 - DNA, 25 bp, Rattus norvegicus
ttgctgtggctaactttctggtatc

SEQ ID NO: 680128 - DNA, 25 bp, Rattus norvegicus
ttgctgtggctatctttctggtatc

SEQ ID NO: 680129 - DNA, 25 bp, Rattus norvegicus
ttgctgttatttccccatactctgg

SEQ ID NO: 680130 - DNA, 25 bp, Rattus norvegicus
ttgctgttatttgcccatactctgg

SEQ ID NO: 680131 - DNA, 25 bp, Rattus norvegicus
ttgctgttccaacactccagaagct

SEQ ID NO: 680132 - DNA, 25 bp, Rattus norvegicus
ttgctgttccaagactccagaagct

SEQ ID NO: 680133 - DNA, 25 bp, Rattus norvegicus
ttgctgttcccaatgatgtgtttta

SEQ ID NO: 680134 - DNA, 25 bp, Rattus norvegicus
ttgctgttcccattgatgtgtttta

SEQ ID NO: 680135 - DNA, 25 bp, Rattus norvegicus
ttgctgttgctaacgctgttttata

SEQ ID NO: 680136 - DNA, 25 bp, Rattus norvegicus
ttgctgttgctatcgctgttttata

SEQ ID NO: 680137 - DNA, 25 bp, Rattus norvegicus
ttgctgttgctcatcaggtctaaag

SEQ ID NO: 680138 - DNA, 25 bp, Rattus norvegicus
ttgctgttgctcttcaggtctaaag

SEQ ID NO: 680139 - DNA, 25 bp, Rattus norvegicus
ttgctgttggttctcaaacctctgt

SEQ ID NO: 680140 - DNA, 25 bp, Rattus norvegicus
ttgctgttggttgtcaaacctctgt

SEQ ID NO: 680141 - DNA, 25 bp, Rattus norvegicus
ttgctgttgtcaccagtccaaaagc

SEQ ID NO: 680142 - DNA, 25 bp, Rattus norvegicus
ttgctgttgtcagcagtccaaaagc

SEQ ID NO: 680143 - DNA, 25 bp, Rattus norvegicus
ttgctgtttacaatcctttgctgag

SEQ ID NO: 680144 - DNA, 25 bp, Rattus norvegicus
ttgctgtttacattcctttgctgag

SEQ ID NO: 680145 - DNA, 25 bp, Rattus norvegicus
ttgctgtttggcagagggtttccta

SEQ ID NO: 680146 - DNA, 25 bp, Rattus norvegicus
ttgctgtttggctgagggtttccta

SEQ ID NO: 680147 - DNA, 25 bp, Rattus norvegicus
ttgctgtttgtgatgcttccctcta

SEQ ID NO: 680148 - DNA, 25 bp, Rattus norvegicus
ttgctgtttgtgttgcttccctcta

SEQ ID NO: 680149 - DNA, 25 bp, Rattus norvegicus
ttgctgttttccacaaacttgcgac

SEQ ID NO: 680150 - DNA, 25 bp, Rattus norvegicus
ttgctgttttcctcaaacttgcgac

SEQ ID NO: 680151 - DNA, 25 bp, Rattus norvegicus
ttgctgtttttgattagttcagatc

SEQ ID NO: 680152 - DNA, 25 bp, Rattus norvegicus
ttgctgtttttgtttagttcagatc

SEQ ID NO: 680153 - DNA, 25 bp, Rattus norvegicus
ttgcttaacctaactgagccctaga

SEQ ID NO: 680154 - DNA, 25 bp, Rattus norvegicus
ttgcttaacctatctgagccctaga

SEQ ID NO: 680155 - DNA, 25 bp, Rattus norvegicus
ttgcttaacttcactcgatgggaca

SEQ ID NO: 680156 - DNA, 25 bp, Rattus norvegicus
ttgcttaacttctctcgatgggaca

SEQ ID NO: 680157 - DNA, 25 bp, Rattus norvegicus
ttgcttacaaataccctgagtgcat

SEQ ID NO: 680158 - DNA, 25 bp, Rattus norvegicus
ttgcttacaaattccctgagtgcat

SEQ ID NO: 680159 - DNA, 25 bp, Rattus norvegicus
ttgcttaccatacatcagctctgac

SEQ ID NO: 680160 - DNA, 25 bp, Rattus norvegicus
ttgcttaccatagatcagctctgac

SEQ ID NO: 680161 - DNA, 25 bp, Rattus norvegicus
ttgcttacccttagccattctcaat

SEQ ID NO: 680162 - DNA, 25 bp, Rattus norvegicus
ttgcttaccctttgccattctcaat

SEQ ID NO: 680163 - DNA, 25 bp, Rattus norvegicus
ttgcttagaactcctgaacccactt

SEQ ID NO: 680164 - DNA, 25 bp, Rattus norvegicus
ttgcttagaactgctgaacccactt

SEQ ID NO: 680165 - DNA, 25 bp, Rattus norvegicus
ttgcttagcctaatatgttcctata

SEQ ID NO: 680166 - DNA, 25 bp, Rattus norvegicus
ttgcttagcctattatgttcctata

SEQ ID NO: 680167 - DNA, 25 bp, Rattus norvegicus
ttgcttaggacccaggagcctgctc

SEQ ID NO: 680168 - DNA, 25 bp, Rattus norvegicus
ttgcttaggaccgaggagcctgctc

SEQ ID NO: 680169 - DNA, 25 bp, Rattus norvegicus
ttgcttaggattcaggctggccaca

SEQ ID NO: 680170 - DNA, 25 bp, Rattus norvegicus
ttgcttaggattgaggctggccaca

SEQ ID NO: 680171 - DNA, 25 bp, Rattus norvegicus
ttgcttaggccaaggcaagagcgga

SEQ ID NO: 680172 - DNA, 25 bp, Rattus norvegicus
ttgcttaggccatggcaagagcgga

SEQ ID NO: 680173 - DNA, 25 bp, Rattus norvegicus
ttgcttatcaccattctttctttgt

SEQ ID NO: 680174 - DNA, 25 bp, Rattus norvegicus
ttgcttatcacctttctttctttgt

SEQ ID NO: 680175 - DNA, 25 bp, Rattus norvegicus
ttgcttatcctaaccctacaagatg

SEQ ID NO: 680176 - DNA, 25 bp, Rattus norvegicus
ttgcttatcctatccctacaagatg

SEQ ID NO: 680177 - DNA, 25 bp, Rattus norvegicus
ttgcttatctgtatccaccatatca

SEQ ID NO: 680178 - DNA, 25 bp, Rattus norvegicus
ttgcttatctgtttccaccatatca

SEQ ID NO: 680179 - DNA, 25 bp, Rattus norvegicus
ttgcttatcttgaagcatagggaca

SEQ ID NO: 680180 - DNA, 25 bp, Rattus norvegicus
ttgcttatcttgtagcatagggaca

SEQ ID NO: 680181 - DNA, 25 bp, Rattus norvegicus
ttgcttatgggacatgagcgtgtaa

SEQ ID NO: 680182 - DNA, 25 bp, Rattus norvegicus
ttgcttatgggagatgagcgtgtaa

SEQ ID NO: 680183 - DNA, 25 bp, Rattus norvegicus
ttgcttattgggattcattctcata

SEQ ID NO: 680184 - DNA, 25 bp, Rattus norvegicus
ttgcttattgggtttcattctcata

SEQ ID NO: 680185 - DNA, 25 bp, Rattus norvegicus
ttgcttatttttagtatcgaggtta

SEQ ID NO: 680186 - DNA, 25 bp, Rattus norvegicus
ttgcttattttttgtatcgaggtta

SEQ ID NO: 680187 - DNA, 25 bp, Rattus norvegicus
ttgcttcaagaacgtgcccagagat

SEQ ID NO: 680188 - DNA, 25 bp, Rattus norvegicus
ttgcttcaagaaggtgcccagagat

SEQ ID NO: 680189 - DNA, 25 bp, Rattus norvegicus
ttgcttcaataaagtggtcttaaaa

SEQ ID NO: 680190 - DNA, 25 bp, Rattus norvegicus
ttgcttcaataatgtggtcttaaaa

SEQ ID NO: 680191 - DNA, 25 bp, Rattus norvegicus
ttgcttcagcgaccctcgagagcgg

SEQ ID NO: 680192 - DNA, 25 bp, Rattus norvegicus
ttgcttcagcgagcctcgagagcgg

SEQ ID NO: 680193 - DNA, 25 bp, Rattus norvegicus
ttgcttcagggactgtcctgttgac

SEQ ID NO: 680194 - DNA, 25 bp, Rattus norvegicus
ttgcttcagggagtgtcctgttgac

SEQ ID NO: 680195 - DNA, 25 bp, Rattus norvegicus
ttgcttcatcttctccatggttggt

SEQ ID NO: 680196 - DNA, 25 bp, Rattus norvegicus
ttgcttcatcttgtccatggttggt

SEQ ID NO: 680197 - DNA, 25 bp, Rattus norvegicus
ttgcttcatggtctacacgctggag

SEQ ID NO: 680198 - DNA, 25 bp, Rattus norvegicus
ttgcttcatggtgtacacgctggag

SEQ ID NO: 680199 - DNA, 25 bp, Rattus norvegicus
ttgcttcattttacccttggaaccg

SEQ ID NO: 680200 - DNA, 25 bp, Rattus norvegicus
ttgcttcatttttcccttggaaccg

SEQ ID NO: 680201 - DNA, 25 bp, Rattus norvegicus
ttgcttccacggattccatttaact

SEQ ID NO: 680202 - DNA, 25 bp, Rattus norvegicus
ttgcttccacggtttccatttaact

SEQ ID NO: 680203 - DNA, 25 bp, Rattus norvegicus
ttgcttccattaaagttaactgagg

SEQ ID NO: 680204 - DNA, 25 bp, Rattus norvegicus
ttgcttccattaatctctcactgtg

SEQ ID NO: 680205 - DNA, 25 bp, Rattus norvegicus
ttgcttccattatagttaactgagg

SEQ ID NO: 680206 - DNA, 25 bp, Rattus norvegicus
ttgcttccattattctctcactgtg

SEQ ID NO: 680207 - DNA, 25 bp, Rattus norvegicus
ttgcttccatttatcatactcacca

SEQ ID NO: 680208 - DNA, 25 bp, Rattus norvegicus
ttgcttccatttttcatactcacca

SEQ ID NO: 680209 - DNA, 25 bp, Rattus norvegicus
ttgcttcccaccctaggtgatggac

SEQ ID NO: 680210 - DNA, 25 bp, Rattus norvegicus
ttgcttcccaccgtaggtgatggac

SEQ ID NO: 680211 - DNA, 25 bp, Rattus norvegicus
ttgcttccctggcttgaacagttta

SEQ ID NO: 680212 - DNA, 25 bp, Rattus norvegicus
ttgcttccctgggttgaacagttta

SEQ ID NO: 680213 - DNA, 25 bp, Rattus norvegicus
ttgcttccctttcagactacctgta

SEQ ID NO: 680214 - DNA, 25 bp, Rattus norvegicus
ttgcttccctttgagactacctgta

SEQ ID NO: 680215 - DNA, 25 bp, Rattus norvegicus
ttgcttcctctgcacaactggagca

SEQ ID NO: 680216 - DNA, 25 bp, Rattus norvegicus
ttgcttcctctggacaactggagca

SEQ ID NO: 680217 - DNA, 25 bp, Rattus norvegicus
ttgcttcctgccatcttcaaaggct

SEQ ID NO: 680218 - DNA, 25 bp, Rattus norvegicus
ttgcttcctgccttcttcaaaggct

SEQ ID NO: 680219 - DNA, 25 bp, Rattus norvegicus
ttgcttcctggtagttgtgtaaaaa

SEQ ID NO: 680220 - DNA, 25 bp, Rattus norvegicus
ttgcttcctggttgttgtgtaaaaa

SEQ ID NO: 680221 - DNA, 25 bp, Rattus norvegicus
ttgcttcctgtgatcttgatgtgac

SEQ ID NO: 680222 - DNA, 25 bp, Rattus norvegicus
ttgcttcctgtgttcttgatgtgac

SEQ ID NO: 680223 - DNA, 25 bp, Rattus norvegicus
ttgcttcctttgctgtggatcagac

SEQ ID NO: 680224 - DNA, 25 bp, Rattus norvegicus
ttgcttcctttggtgtggatcagac

SEQ ID NO: 680225 - DNA, 25 bp, Rattus norvegicus
ttgcttcgacttccagcttccttgg

SEQ ID NO: 680226 - DNA, 25 bp, Rattus norvegicus
ttgcttcgacttgcagcttccttgg

SEQ ID NO: 680227 - DNA, 25 bp, Rattus norvegicus
ttgcttcgagcccaacagccagatg

SEQ ID NO: 680228 - DNA, 25 bp, Rattus norvegicus
ttgcttcgagccgaacagccagatg

SEQ ID NO: 680229 - DNA, 25 bp, Rattus norvegicus
ttgcttcgggcacaggagagcgcgt

SEQ ID NO: 680230 - DNA, 25 bp, Rattus norvegicus
ttgcttcgggcagaggagagcgcgt

SEQ ID NO: 680231 - DNA, 25 bp, Rattus norvegicus
ttgcttcgtcttatgtgtccccaaa

SEQ ID NO: 680232 - DNA, 25 bp, Rattus norvegicus
ttgcttcgtcttttgtgtccccaaa

SEQ ID NO: 680233 - DNA, 25 bp, Rattus norvegicus
ttgcttctatctcaaggacagactt

SEQ ID NO: 680234 - DNA, 25 bp, Rattus norvegicus
ttgcttctatctgaaggacagactt

SEQ ID NO: 680235 - DNA, 25 bp, Rattus norvegicus
ttgcttctcaaacaatcctctgtag

SEQ ID NO: 680236 - DNA, 25 bp, Rattus norvegicus
ttgcttctcaaagaatcctctgtag

SEQ ID NO: 680237 - DNA, 25 bp, Rattus norvegicus
ttgcttctcaagatgagcgcccgag

SEQ ID NO: 680238 - DNA, 25 bp, Rattus norvegicus
ttgcttctcaagcttctgttttagt

SEQ ID NO: 680239 - DNA, 25 bp, Rattus norvegicus
ttgcttctcaaggttctgttttagt

SEQ ID NO: 680240 - DNA, 25 bp, Rattus norvegicus
ttgcttctcaagttgagcgcccgag

SEQ ID NO: 680241 - DNA, 25 bp, Rattus norvegicus
ttgcttctcataacgaatgccaatg

SEQ ID NO: 680242 - DNA, 25 bp, Rattus norvegicus
ttgcttctcatatcgaatgccaatg

SEQ ID NO: 680243 - DNA, 25 bp, Rattus norvegicus
ttgcttctcgaaacagttgcttggc

SEQ ID NO: 680244 - DNA, 25 bp, Rattus norvegicus
ttgcttctcgaatcagttgcttggc

SEQ ID NO: 680245 - DNA, 25 bp, Rattus norvegicus
ttgcttctctgactgaatcgtggga

SEQ ID NO: 680246 - DNA, 25 bp, Rattus norvegicus
ttgcttctctgagtgaatcgtggga

SEQ ID NO: 680247 - DNA, 25 bp, Rattus norvegicus
ttgcttctgagcctccagtaacaag

SEQ ID NO: 680248 - DNA, 25 bp, Rattus norvegicus
ttgcttctgagcgtccagtaacaag

SEQ ID NO: 680249 - DNA, 25 bp, Rattus norvegicus
ttgcttctgcatccttcgtgtctgt

SEQ ID NO: 680250 - DNA, 25 bp, Rattus norvegicus
ttgcttctgcatgcttcgtgtctgt

SEQ ID NO: 680251 - DNA, 25 bp, Rattus norvegicus
ttgcttctgtctatcccattgtggc

SEQ ID NO: 680252 - DNA, 25 bp, Rattus norvegicus
ttgcttctgtctttcccattgtggc

SEQ ID NO: 680253 - DNA, 25 bp, Rattus norvegicus
ttgcttctgtgactcgtattgggtt

SEQ ID NO: 680254 - DNA, 25 bp, Rattus norvegicus
ttgcttctgtgagtcgtattgggtt

SEQ ID NO: 680255 - DNA, 25 bp, Rattus norvegicus
ttgcttctgttaaccatcatttttg

SEQ ID NO: 680256 - DNA, 25 bp, Rattus norvegicus
ttgcttctgttatccatcatttttg

SEQ ID NO: 680257 - DNA, 25 bp, Rattus norvegicus
ttgcttcttaaacacttactggtag

SEQ ID NO: 680258 - DNA, 25 bp, Rattus norvegicus
ttgcttcttaaagacttactggtag

SEQ ID NO: 680259 - DNA, 25 bp, Rattus norvegicus
ttgcttcttacccaggctagattgc

SEQ ID NO: 680260 - DNA, 25 bp, Rattus norvegicus
ttgcttcttaccgaggctagattgc

SEQ ID NO: 680261 - DNA, 25 bp, Rattus norvegicus
ttgcttctttcaaggcggacgtgga

SEQ ID NO: 680262 - DNA, 25 bp, Rattus norvegicus
ttgcttctttcatggcggacgtgga

SEQ ID NO: 680263 - DNA, 25 bp, Rattus norvegicus
ttgcttctttctatttcatacccga

SEQ ID NO: 680264 - DNA, 25 bp, Rattus norvegicus
ttgcttctttctttttcatacccga

SEQ ID NO: 680265 - DNA, 25 bp, Rattus norvegicus
ttgcttgaagcaaaacaggctgaca

SEQ ID NO: 680266 - DNA, 25 bp, Rattus norvegicus
ttgcttgaagcataacaggctgaca

SEQ ID NO: 680267 - DNA, 25 bp, Rattus norvegicus
ttgcttgaagccctgaaggttgttt

SEQ ID NO: 680268 - DNA, 25 bp, Rattus norvegicus
ttgcttgaagccgtgaaggttgttt

SEQ ID NO: 680269 - DNA, 25 bp, Rattus norvegicus
ttgcttgaccaaagctcccaaggga

SEQ ID NO: 680270 - DNA, 25 bp, Rattus norvegicus
ttgcttgaccaatgctcccaaggga

SEQ ID NO: 680271 - DNA, 25 bp, Rattus norvegicus
ttgcttgaccatcaggatctctttc

SEQ ID NO: 680272 - DNA, 25 bp, Rattus norvegicus
ttgcttgaccatgaggatctctttc

SEQ ID NO: 680273 - DNA, 25 bp, Rattus norvegicus
ttgcttgatctgatgtcgcttctcc

SEQ ID NO: 680274 - DNA, 25 bp, Rattus norvegicus
ttgcttgatctgttgtcgcttctcc

SEQ ID NO: 680275 - DNA, 25 bp, Rattus norvegicus
ttgcttgcactcactaaatttctta

SEQ ID NO: 680276 - DNA, 25 bp, Rattus norvegicus
ttgcttgcactctctaaatttctta

SEQ ID NO: 680277 - DNA, 25 bp, Rattus norvegicus
ttgcttgccaccagacttaaggtgt

SEQ ID NO: 680278 - DNA, 25 bp, Rattus norvegicus
ttgcttgccacctgacttaaggtgt

SEQ ID NO: 680279 - DNA, 25 bp, Rattus norvegicus
ttgcttgcccttcttttctaaatag

SEQ ID NO: 680280 - DNA, 25 bp, Rattus norvegicus
ttgcttgcccttgttttctaaatag

SEQ ID NO: 680281 - DNA, 25 bp, Rattus norvegicus
ttgcttgcctgcagtctacaaagag

SEQ ID NO: 680282 - DNA, 25 bp, Rattus norvegicus
ttgcttgcctgctgtctacaaagag

SEQ ID NO: 680283 - DNA, 25 bp, Rattus norvegicus
ttgcttgctccaccaccatggacta

SEQ ID NO: 680284 - DNA, 25 bp, Rattus norvegicus
ttgcttgctccagcaccatggacta

SEQ ID NO: 680285 - DNA, 25 bp, Rattus norvegicus
ttgcttggaggcagtattccaggat

SEQ ID NO: 680286 - DNA, 25 bp, Rattus norvegicus
ttgcttggaggctgtattccaggat

SEQ ID NO: 680287 - DNA, 25 bp, Rattus norvegicus
ttgcttggcaatcactgctccacta

SEQ ID NO: 680288 - DNA, 25 bp, Rattus norvegicus
ttgcttggcaatgactgctccacta

SEQ ID NO: 680289 - DNA, 25 bp, Rattus norvegicus
ttgcttggctcaattggtttttgta

SEQ ID NO: 680290 - DNA, 25 bp, Rattus norvegicus
ttgcttggctcatttggtttttgta

SEQ ID NO: 680291 - DNA, 25 bp, Rattus norvegicus
ttgcttgggaggaaacaggcaccga

SEQ ID NO: 680292 - DNA, 25 bp, Rattus norvegicus
ttgcttgggaggtaacaggcaccga

SEQ ID NO: 680293 - DNA, 25 bp, Rattus norvegicus
ttgcttgggttcctatctcgacttc

SEQ ID NO: 680294 - DNA, 25 bp, Rattus norvegicus
ttgcttgggttcgtatctcgacttc

SEQ ID NO: 680295 - DNA, 25 bp, Rattus norvegicus
ttgcttgtacaactgccactctgta

SEQ ID NO: 680296 - DNA, 25 bp, Rattus norvegicus
ttgcttgtacaagtgccactctgta

SEQ ID NO: 680297 - DNA, 25 bp, Rattus norvegicus
ttgcttgtcacacagcgctacagga

SEQ ID NO: 680298 - DNA, 25 bp, Rattus norvegicus
ttgcttgtcacagagcgctacagga

SEQ ID NO: 680299 - DNA, 25 bp, Rattus norvegicus
ttgcttgtcagtccccgcaaagaag

SEQ ID NO: 680300 - DNA, 25 bp, Rattus norvegicus
ttgcttgtcagtgcccgcaaagaag

SEQ ID NO: 680301 - DNA, 25 bp, Rattus norvegicus
ttgcttgtcctaaatcaccacttat

SEQ ID NO: 680302 - DNA, 25 bp, Rattus norvegicus
ttgcttgtcctatatcaccacttat

SEQ ID NO: 680303 - DNA, 25 bp, Rattus norvegicus
ttgcttgtggaaacccgtgtacttt

SEQ ID NO: 680304 - DNA, 25 bp, Rattus norvegicus
ttgcttgtggaatcccgtgtacttt

SEQ ID NO: 680305 - DNA, 25 bp, Rattus norvegicus
ttgcttgtggctcttttctttattt

SEQ ID NO: 680306 - DNA, 25 bp, Rattus norvegicus
ttgcttgtggctgttttctttattt

SEQ ID NO: 680307 - DNA, 25 bp, Rattus norvegicus
ttgcttgttcccagctcaaaatgag

SEQ ID NO: 680308 - DNA, 25 bp, Rattus norvegicus
ttgcttgttccctgctcaaaatgag

SEQ ID NO: 680309 - DNA, 25 bp, Rattus norvegicus
ttgcttgttgagaacctttggtggc

SEQ ID NO: 680310 - DNA, 25 bp, Rattus norvegicus
ttgcttgttgagtacctttggtggc

SEQ ID NO: 680311 - DNA, 25 bp, Rattus norvegicus
ttgcttgttgtgactgtgggattct

SEQ ID NO: 680312 - DNA, 25 bp, Rattus norvegicus
ttgcttgttgtgtctgtgggattct

SEQ ID NO: 680313 - DNA, 25 bp, Rattus norvegicus
ttgcttgttgttagtgccattctta

SEQ ID NO: 680314 - DNA, 25 bp, Rattus norvegicus
ttgcttgttgtttgtgccattctta

SEQ ID NO: 680315 - DNA, 25 bp, Rattus norvegicus
ttgcttgttttccttgtgtctctgc

SEQ ID NO: 680316 - DNA, 25 bp, Rattus norvegicus
ttgcttgttttcgttgtgtctctgc

SEQ ID NO: 680317 - DNA, 25 bp, Rattus norvegicus
ttgcttgtttttaccttccactaga

SEQ ID NO: 680318 - DNA, 25 bp, Rattus norvegicus
ttgcttgttttttccttccactaga

SEQ ID NO: 680319 - DNA, 25 bp, Rattus norvegicus
ttgctttaaactcacaggccttctt

SEQ ID NO: 680320 - DNA, 25 bp, Rattus norvegicus
ttgctttaaactgacaggccttctt

SEQ ID NO: 680321 - DNA, 25 bp, Rattus norvegicus
ttgctttaaccacttccgcgtagga

SEQ ID NO: 680322 - DNA, 25 bp, Rattus norvegicus
ttgctttaaccagttccgcgtagga

SEQ ID NO: 680323 - DNA, 25 bp, Rattus norvegicus
ttgctttaactaatgcgtgctcgtg

SEQ ID NO: 680324 - DNA, 25 bp, Rattus norvegicus
ttgctttaactattgcgtgctcgtg

SEQ ID NO: 680325 - DNA, 25 bp, Rattus norvegicus
ttgctttaatatacaggcccaagtt

SEQ ID NO: 680326 - DNA, 25 bp, Rattus norvegicus
ttgctttaatatattctcatagact

SEQ ID NO: 680327 - DNA, 25 bp, Rattus norvegicus
ttgctttaatattcaggcccaagtt

SEQ ID NO: 680328 - DNA, 25 bp, Rattus norvegicus
ttgctttaatattttctcatagact

SEQ ID NO: 680329 - DNA, 25 bp, Rattus norvegicus
ttgctttaatttccattccctgtag

SEQ ID NO: 680330 - DNA, 25 bp, Rattus norvegicus
ttgctttaatttgcattccctgtag

SEQ ID NO: 680331 - DNA, 25 bp, Rattus norvegicus
ttgctttactgcctttatgaatatc

SEQ ID NO: 680332 - DNA, 25 bp, Rattus norvegicus
ttgctttactgcgtttatgaatatc

SEQ ID NO: 680333 - DNA, 25 bp, Rattus norvegicus
ttgctttcaaaaaatacagcgcttt

SEQ ID NO: 680334 - DNA, 25 bp, Rattus norvegicus
ttgctttcaaaatatacagcgcttt

SEQ ID NO: 680335 - DNA, 25 bp, Rattus norvegicus
ttgctttcaatgattgcactgatct

SEQ ID NO: 680336 - DNA, 25 bp, Rattus norvegicus
ttgctttcaatgtttgcactgatct

SEQ ID NO: 680337 - DNA, 25 bp, Rattus norvegicus
ttgctttcacttctggcaagttcgt

SEQ ID NO: 680338 - DNA, 25 bp, Rattus norvegicus
ttgctttcacttgtggcaagttcgt

SEQ ID NO: 680339 - DNA, 25 bp, Rattus norvegicus
ttgctttccattcttgtcatcctga

SEQ ID NO: 680340 - DNA, 25 bp, Rattus norvegicus
ttgctttccattgttgtcatcctga

SEQ ID NO: 680341 - DNA, 25 bp, Rattus norvegicus
ttgctttcccttcagccttaaggta

SEQ ID NO: 680342 - DNA, 25 bp, Rattus norvegicus
ttgctttcccttgagccttaaggta

SEQ ID NO: 680343 - DNA, 25 bp, Rattus norvegicus
ttgctttccttccacacaagttctg

SEQ ID NO: 680344 - DNA, 25 bp, Rattus norvegicus
ttgctttccttcgacacaagttctg

SEQ ID NO: 680345 - DNA, 25 bp, Rattus norvegicus
ttgctttcgctcagtcagactgaat

SEQ ID NO: 680346 - DNA, 25 bp, Rattus norvegicus
ttgctttcgctctgtcagactgaat

SEQ ID NO: 680347 - DNA, 25 bp, Rattus norvegicus
ttgctttcggtcatgtgtttgtttt

SEQ ID NO: 680348 - DNA, 25 bp, Rattus norvegicus
ttgctttcggtcttgtgtttgtttt

SEQ ID NO: 680349 - DNA, 25 bp, Rattus norvegicus
ttgctttcggtgattcttacttctc

SEQ ID NO: 680350 - DNA, 25 bp, Rattus norvegicus
ttgctttcggtgtttcttacttctc

SEQ ID NO: 680351 - DNA, 25 bp, Rattus norvegicus
ttgctttcgtccaacttgttctcaa

SEQ ID NO: 680352 - DNA, 25 bp, Rattus norvegicus
ttgctttcgtcctacttgttctcaa

SEQ ID NO: 680353 - DNA, 25 bp, Rattus norvegicus
ttgctttctagaaacaaggtctcat

SEQ ID NO: 680354 - DNA, 25 bp, Rattus norvegicus
ttgctttctagatacaaggtctcat

SEQ ID NO: 680355 - DNA, 25 bp, Rattus norvegicus
ttgctttctaggatccgagtctgga

SEQ ID NO: 680356 - DNA, 25 bp, Rattus norvegicus
ttgctttctaggttccgagtctgga

SEQ ID NO: 680357 - DNA, 25 bp, Rattus norvegicus
ttgctttctcctacaaaggagtata

SEQ ID NO: 680358 - DNA, 25 bp, Rattus norvegicus
ttgctttctccttcaaaggagtata

SEQ ID NO: 680359 - DNA, 25 bp, Rattus norvegicus
ttgctttctcgtcccggtgaccggg

SEQ ID NO: 680360 - DNA, 25 bp, Rattus norvegicus
ttgctttctcgtgccggtgaccggg

SEQ ID NO: 680361 - DNA, 25 bp, Rattus norvegicus
ttgctttctcttaattttagttcct

SEQ ID NO: 680362 - DNA, 25 bp, Rattus norvegicus
ttgctttctctttattttagttcct

SEQ ID NO: 680363 - DNA, 25 bp, Rattus norvegicus
ttgctttctgaaaaccataggccca

SEQ ID NO: 680364 - DNA, 25 bp, Rattus norvegicus
ttgctttctgaataccataggccca

SEQ ID NO: 680365 - DNA, 25 bp, Rattus norvegicus
ttgctttctgtcattcatgtccaca

SEQ ID NO: 680366 - DNA, 25 bp, Rattus norvegicus
ttgctttctgtctttcatgtccaca

SEQ ID NO: 680367 - DNA, 25 bp, Rattus norvegicus
ttgctttcttacatctcactttgat

SEQ ID NO: 680368 - DNA, 25 bp, Rattus norvegicus
ttgctttcttacttctcactttgat

SEQ ID NO: 680369 - DNA, 25 bp, Rattus norvegicus
ttgctttcttagagtacccaggacc

SEQ ID NO: 680370 - DNA, 25 bp, Rattus norvegicus
ttgctttcttagtgtacccaggacc

SEQ ID NO: 680371 - DNA, 25 bp, Rattus norvegicus
ttgctttcttatcctgctaaaccac

SEQ ID NO: 680372 - DNA, 25 bp, Rattus norvegicus
ttgctttcttatgctgctaaaccac

SEQ ID NO: 680373 - DNA, 25 bp, Rattus norvegicus
ttgctttcttctaatttgtcttttg

SEQ ID NO: 680374 - DNA, 25 bp, Rattus norvegicus
ttgctttcttctcgctgtgtatcag

SEQ ID NO: 680375 - DNA, 25 bp, Rattus norvegicus
ttgctttcttctggctgtgtatcag

SEQ ID NO: 680376 - DNA, 25 bp, Rattus norvegicus
ttgctttcttcttatttgtcttttg

SEQ ID NO: 680377 - DNA, 25 bp, Rattus norvegicus
ttgctttgaactacagctccaggtg

SEQ ID NO: 680378 - DNA, 25 bp, Rattus norvegicus
ttgctttgaacttcagctccaggtg

SEQ ID NO: 680379 - DNA, 25 bp, Rattus norvegicus
ttgctttgacccatagttctttgtt

SEQ ID NO: 680380 - DNA, 25 bp, Rattus norvegicus
ttgctttgacccttagttctttgtt

SEQ ID NO: 680381 - DNA, 25 bp, Rattus norvegicus
ttgctttgcttcactggttggacaa

SEQ ID NO: 680382 - DNA, 25 bp, Rattus norvegicus
ttgctttgcttctctggttggacaa

SEQ ID NO: 680383 - DNA, 25 bp, Rattus norvegicus
ttgctttggagaagatctctgttag

SEQ ID NO: 680384 - DNA, 25 bp, Rattus norvegicus
ttgctttggagatgatctctgttag

SEQ ID NO: 680385 - DNA, 25 bp, Rattus norvegicus
ttgctttgggctagtgattttggtt

SEQ ID NO: 680386 - DNA, 25 bp, Rattus norvegicus
ttgctttgggcttgtgattttggtt

SEQ ID NO: 680387 - DNA, 25 bp, Rattus norvegicus
ttgctttggtttctttcctctgttc

SEQ ID NO: 680388 - DNA, 25 bp, Rattus norvegicus
ttgctttggtttgtttcctctgttc

SEQ ID NO: 680389 - DNA, 25 bp, Rattus norvegicus
ttgctttgtcaaatcgctgctaata

SEQ ID NO: 680390 - DNA, 25 bp, Rattus norvegicus
ttgctttgtcaattcgctgctaata

SEQ ID NO: 680391 - DNA, 25 bp, Rattus norvegicus
ttgctttgtccacgcaggcagcagg

SEQ ID NO: 680392 - DNA, 25 bp, Rattus norvegicus
ttgctttgtccaggcaggcagcagg

SEQ ID NO: 680393 - DNA, 25 bp, Rattus norvegicus
ttgctttgtcccagtggtagagcca

SEQ ID NO: 680394 - DNA, 25 bp, Rattus norvegicus
ttgctttgtccctgtggtagagcca

SEQ ID NO: 680395 - DNA, 25 bp, Rattus norvegicus
ttgctttgtctaagtttcaggtgaa

SEQ ID NO: 680396 - DNA, 25 bp, Rattus norvegicus
ttgctttgtctatgtttcaggtgaa

SEQ ID NO: 680397 - DNA, 25 bp, Rattus norvegicus
ttgctttgtgacatctccgtttaac

SEQ ID NO: 680398 - DNA, 25 bp, Rattus norvegicus
ttgctttgtgacttctccgtttaac

SEQ ID NO: 680399 - DNA, 25 bp, Rattus norvegicus
ttgctttgttccctcgtaatttcta

SEQ ID NO: 680400 - DNA, 25 bp, Rattus norvegicus
ttgctttgttccgtcgtaatttcta

SEQ ID NO: 680401 - DNA, 25 bp, Rattus norvegicus
ttgctttgttgtaattgctaaataa

SEQ ID NO: 680402 - DNA, 25 bp, Rattus norvegicus
ttgctttgttgtccgtggtggatat

SEQ ID NO: 680403 - DNA, 25 bp, Rattus norvegicus
ttgctttgttgtgcgtggtggatat

SEQ ID NO: 680404 - DNA, 25 bp, Rattus norvegicus
ttgctttgttgttattgctaaataa

SEQ ID NO: 680405 - DNA, 25 bp, Rattus norvegicus
ttgcttttaaacctccacacagaac

SEQ ID NO: 680406 - DNA, 25 bp, Rattus norvegicus
ttgcttttaaacgtccacacagaac

SEQ ID NO: 680407 - DNA, 25 bp, Rattus norvegicus
ttgcttttcaacatactacttctgg

SEQ ID NO: 680408 - DNA, 25 bp, Rattus norvegicus
ttgcttttcaacttactacttctgg

SEQ ID NO: 680409 - DNA, 25 bp, Rattus norvegicus
ttgcttttctaaacccgtgcttcga

SEQ ID NO: 680410 - DNA, 25 bp, Rattus norvegicus
ttgcttttctaatcccgtgcttcga

SEQ ID NO: 680411 - DNA, 25 bp, Rattus norvegicus
ttgcttttctacagggcgcaaaata

SEQ ID NO: 680412 - DNA, 25 bp, Rattus norvegicus
ttgcttttctactgggcgcaaaata

SEQ ID NO: 680413 - DNA, 25 bp, Rattus norvegicus
ttgcttttctcacctgttttcagct

SEQ ID NO: 680414 - DNA, 25 bp, Rattus norvegicus
ttgcttttctcacgaagtaggccct

SEQ ID NO: 680415 - DNA, 25 bp, Rattus norvegicus
ttgcttttctcagctgttttcagct

SEQ ID NO: 680416 - DNA, 25 bp, Rattus norvegicus
ttgcttttctcaggaagtaggccct

SEQ ID NO: 680417 - DNA, 25 bp, Rattus norvegicus
ttgcttttctccctaaccatactta

SEQ ID NO: 680418 - DNA, 25 bp, Rattus norvegicus
ttgcttttctccgtaaccatactta

SEQ ID NO: 680419 - DNA, 25 bp, Rattus norvegicus
ttgcttttgcaaccttgtttccaag

SEQ ID NO: 680420 - DNA, 25 bp, Rattus norvegicus
ttgcttttgcaagcttgtttccaag

SEQ ID NO: 680421 - DNA, 25 bp, Rattus norvegicus
ttgcttttgcatactcgttttcttt

SEQ ID NO: 680422 - DNA, 25 bp, Rattus norvegicus
ttgcttttgcattctcgttttcttt

SEQ ID NO: 680423 - DNA, 25 bp, Rattus norvegicus
ttgcttttgcttcatgagattgttt

SEQ ID NO: 680424 - DNA, 25 bp, Rattus norvegicus
ttgcttttgcttgatgagattgttt

SEQ ID NO: 680425 - DNA, 25 bp, Rattus norvegicus
ttgcttttgggtactttctggtatt

SEQ ID NO: 680426 - DNA, 25 bp, Rattus norvegicus
ttgcttttgggttctttctggtatt

SEQ ID NO: 680427 - DNA, 25 bp, Rattus norvegicus
ttgctttttcatctgcttcagaaag

SEQ ID NO: 680428 - DNA, 25 bp, Rattus norvegicus
ttgctttttcatgtgcttcagaaag

SEQ ID NO: 680429 - DNA, 25 bp, Rattus norvegicus
ttgctttttcctagagtattcacat

SEQ ID NO: 680430 - DNA, 25 bp, Rattus norvegicus
ttgctttttccttgagtattcacat

SEQ ID NO: 680431 - DNA, 25 bp, Rattus norvegicus
ttgctttttcggatggcttctctca

SEQ ID NO: 680432 - DNA, 25 bp, Rattus norvegicus
ttgctttttcggttggcttctctca

SEQ ID NO: 680433 - DNA, 25 bp, Rattus norvegicus
ttgctttttcttatggcaaagataa

SEQ ID NO: 680434 - DNA, 25 bp, Rattus norvegicus
ttgctttttcttcacctgtgatatg

SEQ ID NO: 680435 - DNA, 25 bp, Rattus norvegicus
ttgctttttcttgacctgtgatatg

SEQ ID NO: 680436 - DNA, 25 bp, Rattus norvegicus
ttgctttttcttttggcaaagataa

SEQ ID NO: 680437 - DNA, 25 bp, Rattus norvegicus
ttgcttttttcccactgcgtccata

SEQ ID NO: 680438 - DNA, 25 bp, Rattus norvegicus
ttgcttttttcccagagtctgatgg

SEQ ID NO: 680439 - DNA, 25 bp, Rattus norvegicus
ttgcttttttccgactgcgtccata

SEQ ID NO: 680440 - DNA, 25 bp, Rattus norvegicus
ttgcttttttccgagagtctgatgg

SEQ ID NO: 680441 - DNA, 25 bp, Rattus norvegicus
ttgcttttttgcacctttgttacca

SEQ ID NO: 680442 - DNA, 25 bp, Rattus norvegicus
ttgcttttttgctcctttgttacca

SEQ ID NO: 680443 - DNA, 25 bp, Rattus norvegicus
ttggaaaagtccctttctctgccga

SEQ ID NO: 680444 - DNA, 25 bp, Rattus norvegicus
ttggaaaagtccgtttctctgccga

SEQ ID NO: 680445 - DNA, 25 bp, Rattus norvegicus
ttggaaaatcgtacaccgtcaatta

SEQ ID NO: 680446 - DNA, 25 bp, Rattus norvegicus
ttggaaaatcgttcaccgtcaatta

SEQ ID NO: 680447 - DNA, 25 bp, Rattus norvegicus
ttggaaaatggtactcactcctgcc

SEQ ID NO: 680448 - DNA, 25 bp, Rattus norvegicus
ttggaaaatggttctcactcctgcc

SEQ ID NO: 680449 - DNA, 25 bp, Rattus norvegicus
ttggaaacattaagcctctgagggc

SEQ ID NO: 680450 - DNA, 25 bp, Rattus norvegicus
ttggaaacattatgcctctgagggc

SEQ ID NO: 680451 - DNA, 25 bp, Rattus norvegicus
ttggaaaccaggaattcaagaggat

SEQ ID NO: 680452 - DNA, 25 bp, Rattus norvegicus
ttggaaaccaggtattcaagaggat

SEQ ID NO: 680453 - DNA, 25 bp, Rattus norvegicus
ttggaaacctgaccgaagtccctct

SEQ ID NO: 680454 - DNA, 25 bp, Rattus norvegicus
ttggaaacctgagcgaagtccctct

SEQ ID NO: 680455 - DNA, 25 bp, Rattus norvegicus
ttggaaacctgtcctcaccgtgaac

SEQ ID NO: 680456 - DNA, 25 bp, Rattus norvegicus
ttggaaacctgtgctcaccgtgaac

SEQ ID NO: 680457 - DNA, 25 bp, Rattus norvegicus
ttggaaaccttcaactgtcttgctt

SEQ ID NO: 680458 - DNA, 25 bp, Rattus norvegicus
ttggaaaccttctactgtcttgctt

SEQ ID NO: 680459 - DNA, 25 bp, Rattus norvegicus
ttggaaacggacattttctgccctc

SEQ ID NO: 680460 - DNA, 25 bp, Rattus norvegicus
ttggaaacggactttttctgccctc

SEQ ID NO: 680461 - DNA, 25 bp, Rattus norvegicus
ttggaaactccaaaatgtcctttag

SEQ ID NO: 680462 - DNA, 25 bp, Rattus norvegicus
ttggaaactccataatgtcctttag

SEQ ID NO: 680463 - DNA, 25 bp, Rattus norvegicus
ttggaaactgatcctacactcctag

SEQ ID NO: 680464 - DNA, 25 bp, Rattus norvegicus
ttggaaactgatgctacactcctag

SEQ ID NO: 680465 - DNA, 25 bp, Rattus norvegicus
ttggaaactttgcagctcacccaaa

SEQ ID NO: 680466 - DNA, 25 bp, Rattus norvegicus
ttggaaactttggagctcacccaaa

SEQ ID NO: 680467 - DNA, 25 bp, Rattus norvegicus
ttggaaagcagcaacttacctaccc

SEQ ID NO: 680468 - DNA, 25 bp, Rattus norvegicus
ttggaaagcagctacttacctaccc

SEQ ID NO: 680469 - DNA, 25 bp, Rattus norvegicus
ttggaaaggacacagcgtccgctct

SEQ ID NO: 680470 - DNA, 25 bp, Rattus norvegicus
ttggaaaggacagagcgtccgctct

SEQ ID NO: 680471 - DNA, 25 bp, Rattus norvegicus
ttggaaaggatcagggttttattag

SEQ ID NO: 680472 - DNA, 25 bp, Rattus norvegicus
ttggaaaggatctgggttttattag

SEQ ID NO: 680473 - DNA, 25 bp, Rattus norvegicus
ttggaaataagtcgctacccgactc

SEQ ID NO: 680474 - DNA, 25 bp, Rattus norvegicus
ttggaaataagtggctacccgactc

SEQ ID NO: 680475 - DNA, 25 bp, Rattus norvegicus
ttggaaatatccaatcctggctggg

SEQ ID NO: 680476 - DNA, 25 bp, Rattus norvegicus
ttggaaatatcctatcctggctggg

SEQ ID NO: 680477 - DNA, 25 bp, Rattus norvegicus
ttggaaatccttcctgatcatccct

SEQ ID NO: 680478 - DNA, 25 bp, Rattus norvegicus
ttggaaatccttgctgatcatccct

SEQ ID NO: 680479 - DNA, 25 bp, Rattus norvegicus
ttggaaatgctgctcacggacggtc

SEQ ID NO: 680480 - DNA, 25 bp, Rattus norvegicus
ttggaaatgctggtcacggacggtc

SEQ ID NO: 680481 - DNA, 25 bp, Rattus norvegicus
ttggaaattaagaccttgtgcccag

SEQ ID NO: 680482 - DNA, 25 bp, Rattus norvegicus
ttggaaattaagtccttgtgcccag

SEQ ID NO: 680483 - DNA, 25 bp, Rattus norvegicus
ttggaacaacagataaaccctcagg

SEQ ID NO: 680484 - DNA, 25 bp, Rattus norvegicus
ttggaacaacagttaaaccctcagg

SEQ ID NO: 680485 - DNA, 25 bp, Rattus norvegicus
ttggaacaaccactgagctacggag

SEQ ID NO: 680486 - DNA, 25 bp, Rattus norvegicus
ttggaacaaccagtgagctacggag

SEQ ID NO: 680487 - DNA, 25 bp, Rattus norvegicus
ttggaacactaactctggttttgct

SEQ ID NO: 680488 - DNA, 25 bp, Rattus norvegicus
ttggaacactaagtctggttttgct

SEQ ID NO: 680489 - DNA, 25 bp, Rattus norvegicus
ttggaacagactcttgtcggcctag

SEQ ID NO: 680490 - DNA, 25 bp, Rattus norvegicus
ttggaacagactgttgtcggcctag

SEQ ID NO: 680491 - DNA, 25 bp, Rattus norvegicus
ttggaacaggctagcccagcatcat

SEQ ID NO: 680492 - DNA, 25 bp, Rattus norvegicus
ttggaacaggcttgcccagcatcat

SEQ ID NO: 680493 - DNA, 25 bp, Rattus norvegicus
ttggaacagtccactccaatctgtt

SEQ ID NO: 680494 - DNA, 25 bp, Rattus norvegicus
ttggaacagtcctctccaatctgtt

SEQ ID NO: 680495 - DNA, 25 bp, Rattus norvegicus
ttggaacagtgaatccgtcccattc

SEQ ID NO: 680496 - DNA, 25 bp, Rattus norvegicus
ttggaacagtgattccgtcccattc

SEQ ID NO: 680497 - DNA, 25 bp, Rattus norvegicus
ttggaacagttgactgctccacact

SEQ ID NO: 680498 - DNA, 25 bp, Rattus norvegicus
ttggaacagttgtctgctccacact

SEQ ID NO: 680499 - DNA, 25 bp, Rattus norvegicus
ttggaacatcctactgtaagctgag

SEQ ID NO: 680500 - DNA, 25 bp, Rattus norvegicus
ttggaacatccttctgtaagctgag

SEQ ID NO: 680501 - DNA, 25 bp, Rattus norvegicus
ttggaacatcgtcccaaaacaactt

SEQ ID NO: 680502 - DNA, 25 bp, Rattus norvegicus
ttggaacatcgtgccaaaacaactt

SEQ ID NO: 680503 - DNA, 25 bp, Rattus norvegicus
ttggaaccaccacgcctctagaaat

SEQ ID NO: 680504 - DNA, 25 bp, Rattus norvegicus
ttggaaccaccaggcctctagaaat

SEQ ID NO: 680505 - DNA, 25 bp, Rattus norvegicus
ttggaaccacttagggcgggagtat

SEQ ID NO: 680506 - DNA, 25 bp, Rattus norvegicus
ttggaaccactttgggcgggagtat

SEQ ID NO: 680507 - DNA, 25 bp, Rattus norvegicus
ttggaaccaggacccattttctctt

SEQ ID NO: 680508 - DNA, 25 bp, Rattus norvegicus
ttggaaccaggagccattttctctt

SEQ ID NO: 680509 - DNA, 25 bp, Rattus norvegicus
ttggaaccaggcagccgagaatcca

SEQ ID NO: 680510 - DNA, 25 bp, Rattus norvegicus
ttggaaccaggctgccgagaatcca

SEQ ID NO: 680511 - DNA, 25 bp, Rattus norvegicus
ttggaacccaacaggcctgaatcag

SEQ ID NO: 680512 - DNA, 25 bp, Rattus norvegicus
ttggaacccaaccttcttcttcaca

SEQ ID NO: 680513 - DNA, 25 bp, Rattus norvegicus
ttggaacccaacgttcttcttcaca

SEQ ID NO: 680514 - DNA, 25 bp, Rattus norvegicus
ttggaacccaactggcctgaatcag

SEQ ID NO: 680515 - DNA, 25 bp, Rattus norvegicus
ttggaacccaatatcttcctcagtt

SEQ ID NO: 680516 - DNA, 25 bp, Rattus norvegicus
ttggaacccaatttcttcctcagtt

SEQ ID NO: 680517 - DNA, 25 bp, Rattus norvegicus
ttggaacccagtcgctgtacttcac

SEQ ID NO: 680518 - DNA, 25 bp, Rattus norvegicus
ttggaacccagtggctgtacttcac

SEQ ID NO: 680519 - DNA, 25 bp, Rattus norvegicus
ttggaacccattatcctgttcatgt

SEQ ID NO: 680520 - DNA, 25 bp, Rattus norvegicus
ttggaacccattttcctgttcatgt

SEQ ID NO: 680521 - DNA, 25 bp, Rattus norvegicus
ttggaaccgctcacagtgcaagtga

SEQ ID NO: 680522 - DNA, 25 bp, Rattus norvegicus
ttggaaccgctctcagtgcaagtga

SEQ ID NO: 680523 - DNA, 25 bp, Rattus norvegicus
ttggaacctgaaatagcctttgttt

SEQ ID NO: 680524 - DNA, 25 bp, Rattus norvegicus
ttggaacctgaattagcctttgttt

SEQ ID NO: 680525 - DNA, 25 bp, Rattus norvegicus
ttggaacgccaacatctgacacctg

SEQ ID NO: 680526 - DNA, 25 bp, Rattus norvegicus
ttggaacgccaagatctgacacctg

SEQ ID NO: 680527 - DNA, 25 bp, Rattus norvegicus
ttggaacgttttatggcatcgcaac

SEQ ID NO: 680528 - DNA, 25 bp, Rattus norvegicus
ttggaacgttttttggcatcgcaac

SEQ ID NO: 680529 - DNA, 25 bp, Rattus norvegicus
ttggaactacacacaggctccgtgc

SEQ ID NO: 680530 - DNA, 25 bp, Rattus norvegicus
ttggaactacactcaggctccgtgc

SEQ ID NO: 680531 - DNA, 25 bp, Rattus norvegicus
ttggaactagacacgggcgtcagca

SEQ ID NO: 680532 - DNA, 25 bp, Rattus norvegicus
ttggaactagactcgggcgtcagca

SEQ ID NO: 680533 - DNA, 25 bp, Rattus norvegicus
ttggaactctggcttgacagcaagc

SEQ ID NO: 680534 - DNA, 25 bp, Rattus norvegicus
ttggaactctgggttgacagcaagc

SEQ ID NO: 680535 - DNA, 25 bp, Rattus norvegicus
ttggaactgtttatacattgcaagc

SEQ ID NO: 680536 - DNA, 25 bp, Rattus norvegicus
ttggaactgtttttacattgcaagc

SEQ ID NO: 680537 - DNA, 25 bp, Rattus norvegicus
ttggaagacctgcaaggagcgcctt

SEQ ID NO: 680538 - DNA, 25 bp, Rattus norvegicus
ttggaagacctggaaggagcgcctt

SEQ ID NO: 680539 - DNA, 25 bp, Rattus norvegicus
ttggaagacgcaatttccgggtgaa

SEQ ID NO: 680540 - DNA, 25 bp, Rattus norvegicus
ttggaagacgcattttccgggtgaa

SEQ ID NO: 680541 - DNA, 25 bp, Rattus norvegicus
ttggaagactaacccactgtcctgg

SEQ ID NO: 680542 - DNA, 25 bp, Rattus norvegicus
ttggaagactaagccactgtcctgg

SEQ ID NO: 680543 - DNA, 25 bp, Rattus norvegicus
ttggaagacttcactgcttctccag

SEQ ID NO: 680544 - DNA, 25 bp, Rattus norvegicus
ttggaagacttctctgcttctccag

SEQ ID NO: 680545 - DNA, 25 bp, Rattus norvegicus
ttggaagagcgcaggccagctgact

SEQ ID NO: 680546 - DNA, 25 bp, Rattus norvegicus
ttggaagagcgctggccagctgact

SEQ ID NO: 680547 - DNA, 25 bp, Rattus norvegicus
ttggaagagctcaggcctagcccta

SEQ ID NO: 680548 - DNA, 25 bp, Rattus norvegicus
ttggaagagctctggcctagcccta

SEQ ID NO: 680549 - DNA, 25 bp, Rattus norvegicus
ttggaagaggctaccgagagcacca

SEQ ID NO: 680550 - DNA, 25 bp, Rattus norvegicus
ttggaagaggcttccgagagcacca

SEQ ID NO: 680551 - DNA, 25 bp, Rattus norvegicus
ttggaagattccagcatctcattgt

SEQ ID NO: 680552 - DNA, 25 bp, Rattus norvegicus
ttggaagattcctgcatctcattgt

SEQ ID NO: 680553 - DNA, 25 bp, Rattus norvegicus
ttggaagcactgcacgtggcgacat

SEQ ID NO: 680554 - DNA, 25 bp, Rattus norvegicus
ttggaagcactggacgtggcgacat

SEQ ID NO: 680555 - DNA, 25 bp, Rattus norvegicus
ttggaagcatcacccgacagcagga

SEQ ID NO: 680556 - DNA, 25 bp, Rattus norvegicus
ttggaagcatcagccgacagcagga

SEQ ID NO: 680557 - DNA, 25 bp, Rattus norvegicus
ttggaagccagcctacgttaggttg

SEQ ID NO: 680558 - DNA, 25 bp, Rattus norvegicus
ttggaagccagcgtacgttaggttg

SEQ ID NO: 680559 - DNA, 25 bp, Rattus norvegicus
ttggaagcccacaagtgtgtccaca

SEQ ID NO: 680560 - DNA, 25 bp, Rattus norvegicus
ttggaagcccactagtgtgtccaca

SEQ ID NO: 680561 - DNA, 25 bp, Rattus norvegicus
ttggaagccccgaggccacatgtat

SEQ ID NO: 680562 - DNA, 25 bp, Rattus norvegicus
ttggaagccccgtggccacatgtat

SEQ ID NO: 680563 - DNA, 25 bp, Rattus norvegicus
ttggaagcctagagtgccttagcct

SEQ ID NO: 680564 - DNA, 25 bp, Rattus norvegicus
ttggaagcctagtgtgccttagcct

SEQ ID NO: 680565 - DNA, 25 bp, Rattus norvegicus
ttggaagcctccatgaagccttttg

SEQ ID NO: 680566 - DNA, 25 bp, Rattus norvegicus
ttggaagcctccttgaagccttttg

SEQ ID NO: 680567 - DNA, 25 bp, Rattus norvegicus
ttggaagctattccttttcacctta

SEQ ID NO: 680568 - DNA, 25 bp, Rattus norvegicus
ttggaagctattgcttttcacctta

SEQ ID NO: 680569 - DNA, 25 bp, Rattus norvegicus
ttggaaggacaccagacggcagcac

SEQ ID NO: 680570 - DNA, 25 bp, Rattus norvegicus
ttggaaggacacgagacggcagcac

SEQ ID NO: 680571 - DNA, 25 bp, Rattus norvegicus
ttggaaggatcaccaagcgcctgct

SEQ ID NO: 680572 - DNA, 25 bp, Rattus norvegicus
ttggaaggatcagcaagcgcctgct

SEQ ID NO: 680573 - DNA, 25 bp, Rattus norvegicus
ttggaaggcatcctgcgcctaatag

SEQ ID NO: 680574 - DNA, 25 bp, Rattus norvegicus
ttggaaggcatcgtgcgcctaatag

SEQ ID NO: 680575 - DNA, 25 bp, Rattus norvegicus
ttggaaggccccacatcttgaggaa

SEQ ID NO: 680576 - DNA, 25 bp, Rattus norvegicus
ttggaaggcccctcatcttgaggaa

SEQ ID NO: 680577 - DNA, 25 bp, Rattus norvegicus
ttggaaggctgcatattgcgttctc

SEQ ID NO: 680578 - DNA, 25 bp, Rattus norvegicus
ttggaaggctgcttattgcgttctc

SEQ ID NO: 680579 - DNA, 25 bp, Rattus norvegicus
ttggaagggctgagcctaggcattc

SEQ ID NO: 680580 - DNA, 25 bp, Rattus norvegicus
ttggaagggctgtgcctaggcattc

SEQ ID NO: 680581 - DNA, 25 bp, Rattus norvegicus
ttggaaggtgttcttaccctctggt

SEQ ID NO: 680582 - DNA, 25 bp, Rattus norvegicus
ttggaaggtgttgttaccctctggt

SEQ ID NO: 680583 - DNA, 25 bp, Rattus norvegicus
ttggaaggttacattgtcccactgt

SEQ ID NO: 680584 - DNA, 25 bp, Rattus norvegicus
ttggaaggttactttgtcccactgt

SEQ ID NO: 680585 - DNA, 25 bp, Rattus norvegicus
ttggaagtcatactttcctcctgct

SEQ ID NO: 680586 - DNA, 25 bp, Rattus norvegicus
ttggaagtcatagtttcctcctgct

SEQ ID NO: 680587 - DNA, 25 bp, Rattus norvegicus
ttggaagtggtcacatcctgtgtta

SEQ ID NO: 680588 - DNA, 25 bp, Rattus norvegicus
ttggaagtggtctcatcctgtgtta

SEQ ID NO: 680589 - DNA, 25 bp, Rattus norvegicus
ttggaagtgttgcttgccgcctgac

SEQ ID NO: 680590 - DNA, 25 bp, Rattus norvegicus
ttggaagtgttggttgccgcctgac

SEQ ID NO: 680591 - DNA, 25 bp, Rattus norvegicus
ttggaagttccaaaaggctctggct

SEQ ID NO: 680592 - DNA, 25 bp, Rattus norvegicus
ttggaagttccataaggctctggct

SEQ ID NO: 680593 - DNA, 25 bp, Rattus norvegicus
ttggaagttctgacctctctgatgt

SEQ ID NO: 680594 - DNA, 25 bp, Rattus norvegicus
ttggaagttctgtcctctctgatgt

SEQ ID NO: 680595 - DNA, 25 bp, Rattus norvegicus
ttggaagttgacattccactctgcc

SEQ ID NO: 680596 - DNA, 25 bp, Rattus norvegicus
ttggaagttgactttccactctgcc

SEQ ID NO: 680597 - DNA, 25 bp, Rattus norvegicus
ttggaataataaaccccactgccct

SEQ ID NO: 680598 - DNA, 25 bp, Rattus norvegicus
ttggaataataatccccactgccct

SEQ ID NO: 680599 - DNA, 25 bp, Rattus norvegicus
ttggaataggctagtgtcctggctc

SEQ ID NO: 680600 - DNA, 25 bp, Rattus norvegicus
ttggaataggcttgtgtcctggctc

SEQ ID NO: 680601 - DNA, 25 bp, Rattus norvegicus
ttggaatagggtctcacctacagcc

SEQ ID NO: 680602 - DNA, 25 bp, Rattus norvegicus
ttggaatagggtgtcacctacagcc

SEQ ID NO: 680603 - DNA, 25 bp, Rattus norvegicus
ttggaatagtgtagctgcctcgcca

SEQ ID NO: 680604 - DNA, 25 bp, Rattus norvegicus
ttggaatagtgttgctgcctcgcca

SEQ ID NO: 680605 - DNA, 25 bp, Rattus norvegicus
ttggaatcccttactgtcacttatt

SEQ ID NO: 680606 - DNA, 25 bp, Rattus norvegicus
ttggaatccctttctgtcacttatt

SEQ ID NO: 680607 - DNA, 25 bp, Rattus norvegicus
ttggaatcctcaacttctgaagtga

SEQ ID NO: 680608 - DNA, 25 bp, Rattus norvegicus
ttggaatcctcatcttctgaagtga

SEQ ID NO: 680609 - DNA, 25 bp, Rattus norvegicus
ttggaatcctgcctttgatgtcacc

SEQ ID NO: 680610 - DNA, 25 bp, Rattus norvegicus
ttggaatcctgcgtttgatgtcacc

SEQ ID NO: 680611 - DNA, 25 bp, Rattus norvegicus
ttggaatcctgtatgaagtcttgtg

SEQ ID NO: 680612 - DNA, 25 bp, Rattus norvegicus
ttggaatcctgtctgtgtcactcag

SEQ ID NO: 680613 - DNA, 25 bp, Rattus norvegicus
ttggaatcctgtgtgtgtcactcag

SEQ ID NO: 680614 - DNA, 25 bp, Rattus norvegicus
ttggaatcctgtttgaagtcttgtg

SEQ ID NO: 680615 - DNA, 25 bp, Rattus norvegicus
ttggaatcgcaccacttcgtagata

SEQ ID NO: 680616 - DNA, 25 bp, Rattus norvegicus
ttggaatcgcacgacttcgtagata

SEQ ID NO: 680617 - DNA, 25 bp, Rattus norvegicus
ttggaatctccaaatcccttgagaa

SEQ ID NO: 680618 - DNA, 25 bp, Rattus norvegicus
ttggaatctccatatcccttgagaa

SEQ ID NO: 680619 - DNA, 25 bp, Rattus norvegicus
ttggaatctgttattctgtccctct

SEQ ID NO: 680620 - DNA, 25 bp, Rattus norvegicus
ttggaatctgtttttctgtccctct

SEQ ID NO: 680621 - DNA, 25 bp, Rattus norvegicus
ttggaatgaccacttccgatgccag

SEQ ID NO: 680622 - DNA, 25 bp, Rattus norvegicus
ttggaatgaccagttccgatgccag

SEQ ID NO: 680623 - DNA, 25 bp, Rattus norvegicus
ttggaatgattgagtccctctcgtc

SEQ ID NO: 680624 - DNA, 25 bp, Rattus norvegicus
ttggaatgattgtgtccctctcgtc

SEQ ID NO: 680625 - DNA, 25 bp, Rattus norvegicus
ttggaatgccatagctagctgcttg

SEQ ID NO: 680626 - DNA, 25 bp, Rattus norvegicus
ttggaatgccattgctagctgcttg

SEQ ID NO: 680627 - DNA, 25 bp, Rattus norvegicus
ttggaatgcccacaagaacaaatca

SEQ ID NO: 680628 - DNA, 25 bp, Rattus norvegicus
ttggaatgcccagaagaacaaatca

SEQ ID NO: 680629 - DNA, 25 bp, Rattus norvegicus
ttggaatggtgtcgccacttggctc

SEQ ID NO: 680630 - DNA, 25 bp, Rattus norvegicus
ttggaatggtgtggccacttggctc

SEQ ID NO: 680631 - DNA, 25 bp, Rattus norvegicus
ttggaattaaagcatgcccgtgctg

SEQ ID NO: 680632 - DNA, 25 bp, Rattus norvegicus
ttggaattaaaggatgcccgtgctg

SEQ ID NO: 680633 - DNA, 25 bp, Rattus norvegicus
ttggaattcagtcagcttggcctca

SEQ ID NO: 680634 - DNA, 25 bp, Rattus norvegicus
ttggaattcagtgagcttggcctca

SEQ ID NO: 680635 - DNA, 25 bp, Rattus norvegicus
ttggaattcgaaatctggagctggg

SEQ ID NO: 680636 - DNA, 25 bp, Rattus norvegicus
ttggaattcgaattctggagctggg

SEQ ID NO: 680637 - DNA, 25 bp, Rattus norvegicus
ttggaattctccacttcactgtatt

SEQ ID NO: 680638 - DNA, 25 bp, Rattus norvegicus
ttggaattctcctcttcactgtatt

SEQ ID NO: 680639 - DNA, 25 bp, Rattus norvegicus
ttggaattgcagcttccccgagggc

SEQ ID NO: 680640 - DNA, 25 bp, Rattus norvegicus
ttggaattgcaggttccccgagggc

SEQ ID NO: 680641 - DNA, 25 bp, Rattus norvegicus
ttggaatttcataggcttatttacc

SEQ ID NO: 680642 - DNA, 25 bp, Rattus norvegicus
ttggaatttcattggcttatttacc

SEQ ID NO: 680643 - DNA, 25 bp, Rattus norvegicus
ttggaatttcttctgtcctttcttt

SEQ ID NO: 680644 - DNA, 25 bp, Rattus norvegicus
ttggaatttcttgtgtcctttcttt

SEQ ID NO: 680645 - DNA, 25 bp, Rattus norvegicus
ttggacaacagaatcctcgtcaggt

SEQ ID NO: 680646 - DNA, 25 bp, Rattus norvegicus
ttggacaacagattcctcgtcaggt

SEQ ID NO: 680647 - DNA, 25 bp, Rattus norvegicus
ttggacaacagtaagcttcagctct

SEQ ID NO: 680648 - DNA, 25 bp, Rattus norvegicus
ttggacaacagttagcttcagctct

SEQ ID NO: 680649 - DNA, 25 bp, Rattus norvegicus
ttggacaaggtcatggtccacccgc

SEQ ID NO: 680650 - DNA, 25 bp, Rattus norvegicus
ttggacaaggtcttggtccacccgc

SEQ ID NO: 680651 - DNA, 25 bp, Rattus norvegicus
ttggacaagtacatcggcagcgtat

SEQ ID NO: 680652 - DNA, 25 bp, Rattus norvegicus
ttggacaagtacttcggcagcgtat

SEQ ID NO: 680653 - DNA, 25 bp, Rattus norvegicus
ttggacacatttctctgcgttcctg

SEQ ID NO: 680654 - DNA, 25 bp, Rattus norvegicus
ttggacacatttgtctgcgttcctg

SEQ ID NO: 680655 - DNA, 25 bp, Rattus norvegicus
ttggacacccacagatcagatacat

SEQ ID NO: 680656 - DNA, 25 bp, Rattus norvegicus
ttggacacccactgatcagatacat

SEQ ID NO: 680657 - DNA, 25 bp, Rattus norvegicus
ttggacaccgagatgagtaccctcc

SEQ ID NO: 680658 - DNA, 25 bp, Rattus norvegicus
ttggacaccgagttgagtaccctcc

SEQ ID NO: 680659 - DNA, 25 bp, Rattus norvegicus
ttggacacctgccaatgaagtggac

SEQ ID NO: 680660 - DNA, 25 bp, Rattus norvegicus
ttggacacctgcgaatgaagtggac

SEQ ID NO: 680661 - DNA, 25 bp, Rattus norvegicus
ttggacacgcgcatggccacgggca

SEQ ID NO: 680662 - DNA, 25 bp, Rattus norvegicus
ttggacacgcgcttggccacgggca

SEQ ID NO: 680663 - DNA, 25 bp, Rattus norvegicus
ttggacactgaaatccgcattgagt

SEQ ID NO: 680664 - DNA, 25 bp, Rattus norvegicus
ttggacactgaattccgcattgagt

SEQ ID NO: 680665 - DNA, 25 bp, Rattus norvegicus
ttggacagccaaccatgttgccttt

SEQ ID NO: 680666 - DNA, 25 bp, Rattus norvegicus
ttggacagccaagcatgttgccttt

SEQ ID NO: 680667 - DNA, 25 bp, Rattus norvegicus
ttggacagcccaactatcttaaaat

SEQ ID NO: 680668 - DNA, 25 bp, Rattus norvegicus
ttggacagcccatctatcttaaaat

SEQ ID NO: 680669 - DNA, 25 bp, Rattus norvegicus
ttggacaggcgcacgggatacttga

SEQ ID NO: 680670 - DNA, 25 bp, Rattus norvegicus
ttggacaggcgctcgggatacttga

SEQ ID NO: 680671 - DNA, 25 bp, Rattus norvegicus
ttggacaggtttaaaaggcgactct

SEQ ID NO: 680672 - DNA, 25 bp, Rattus norvegicus
ttggacaggttttaaaggcgactct

SEQ ID NO: 680673 - DNA, 25 bp, Rattus norvegicus
ttggacagtataaccgtctaccggt

SEQ ID NO: 680674 - DNA, 25 bp, Rattus norvegicus
ttggacagtatatccgtctaccggt

SEQ ID NO: 680675 - DNA, 25 bp, Rattus norvegicus
ttggacagttacaaccgaaccatcc

SEQ ID NO: 680676 - DNA, 25 bp, Rattus norvegicus
ttggacagttactaccgaaccatcc

SEQ ID NO: 680677 - DNA, 25 bp, Rattus norvegicus
ttggacatagtgctacccgaggacc

SEQ ID NO: 680678 - DNA, 25 bp, Rattus norvegicus
ttggacatagtggtacccgaggacc

SEQ ID NO: 680679 - DNA, 25 bp, Rattus norvegicus
ttggacatagttccatctgccgtga

SEQ ID NO: 680680 - DNA, 25 bp, Rattus norvegicus
ttggacatagttgcatctgccgtga

SEQ ID NO: 680681 - DNA, 25 bp, Rattus norvegicus
ttggacatccatcctctgtagttct

SEQ ID NO: 680682 - DNA, 25 bp, Rattus norvegicus
ttggacatccatgctctgtagttct

SEQ ID NO: 680683 - DNA, 25 bp, Rattus norvegicus
ttggacatccccaagcctgaaggac

SEQ ID NO: 680684 - DNA, 25 bp, Rattus norvegicus
ttggacatcccctagcctgaaggac

SEQ ID NO: 680685 - DNA, 25 bp, Rattus norvegicus
ttggacatcctaatgagccacaatg

SEQ ID NO: 680686 - DNA, 25 bp, Rattus norvegicus
ttggacatcctacacagcgagcact

SEQ ID NO: 680687 - DNA, 25 bp, Rattus norvegicus
ttggacatcctagacagcgagcact

SEQ ID NO: 680688 - DNA, 25 bp, Rattus norvegicus
ttggacatcctattgagccacaatg

SEQ ID NO: 680689 - DNA, 25 bp, Rattus norvegicus
ttggacatgactatcctttcctaat

SEQ ID NO: 680690 - DNA, 25 bp, Rattus norvegicus
ttggacatgactttcctttcctaat

SEQ ID NO: 680691 - DNA, 25 bp, Rattus norvegicus
ttggacatgctgaaattatctcaat

SEQ ID NO: 680692 - DNA, 25 bp, Rattus norvegicus
ttggacatgctgtaattatctcaat

SEQ ID NO: 680693 - DNA, 25 bp, Rattus norvegicus
ttggacatgtgtaagctgcggagtt

SEQ ID NO: 680694 - DNA, 25 bp, Rattus norvegicus
ttggacatgtgttagctgcggagtt

SEQ ID NO: 680695 - DNA, 25 bp, Rattus norvegicus
ttggacattgtcatgcagttggcat

SEQ ID NO: 680696 - DNA, 25 bp, Rattus norvegicus
ttggacattgtcttgcagttggcat

SEQ ID NO: 680697 - DNA, 25 bp, Rattus norvegicus
ttggaccaaaaactagacattactg

SEQ ID NO: 680698 - DNA, 25 bp, Rattus norvegicus
ttggaccaaaaagtagacattactg

SEQ ID NO: 680699 - DNA, 25 bp, Rattus norvegicus
ttggaccacgggatggcaggcacat

SEQ ID NO: 680700 - DNA, 25 bp, Rattus norvegicus
ttggaccacgggttggcaggcacat

SEQ ID NO: 680701 - DNA, 25 bp, Rattus norvegicus
ttggaccactgcaccgaagatacca

SEQ ID NO: 680702 - DNA, 25 bp, Rattus norvegicus
ttggaccactgctccgaagatacca

SEQ ID NO: 680703 - DNA, 25 bp, Rattus norvegicus
ttggaccacttgcatacactcttct

SEQ ID NO: 680704 - DNA, 25 bp, Rattus norvegicus
ttggaccacttggatacactcttct

SEQ ID NO: 680705 - DNA, 25 bp, Rattus norvegicus
ttggaccatgtacgcctcagattag

SEQ ID NO: 680706 - DNA, 25 bp, Rattus norvegicus
ttggaccatgtaggcctcagattag

SEQ ID NO: 680707 - DNA, 25 bp, Rattus norvegicus
ttggaccatttgctcacgctagcta

SEQ ID NO: 680708 - DNA, 25 bp, Rattus norvegicus
ttggaccatttggtcacgctagcta

SEQ ID NO: 680709 - DNA, 25 bp, Rattus norvegicus
ttggacccaagtctgccacttaaag

SEQ ID NO: 680710 - DNA, 25 bp, Rattus norvegicus
ttggacccaagtgtgccacttaaag

SEQ ID NO: 680711 - DNA, 25 bp, Rattus norvegicus
ttggacccagagcagcggcctaagt

SEQ ID NO: 680712 - DNA, 25 bp, Rattus norvegicus
ttggacccagagcttacccagcaga

SEQ ID NO: 680713 - DNA, 25 bp, Rattus norvegicus
ttggacccagaggagcggcctaagt

SEQ ID NO: 680714 - DNA, 25 bp, Rattus norvegicus
ttggacccagaggttacccagcaga

SEQ ID NO: 680715 - DNA, 25 bp, Rattus norvegicus
ttggaccccacgcttgcagactgag

SEQ ID NO: 680716 - DNA, 25 bp, Rattus norvegicus
ttggaccccacggttgcagactgag

SEQ ID NO: 680717 - DNA, 25 bp, Rattus norvegicus
ttggaccccatgataatattttttg

SEQ ID NO: 680718 - DNA, 25 bp, Rattus norvegicus
ttggaccccatgttaatattttttg

SEQ ID NO: 680719 - DNA, 25 bp, Rattus norvegicus
ttggacccctgtaatctccacaact

SEQ ID NO: 680720 - DNA, 25 bp, Rattus norvegicus
ttggacccctgttatctccacaact

SEQ ID NO: 680721 - DNA, 25 bp, Rattus norvegicus
ttggaccctaagacattgcacacgt

SEQ ID NO: 680722 - DNA, 25 bp, Rattus norvegicus
ttggaccctaagtcattgcacacgt

SEQ ID NO: 680723 - DNA, 25 bp, Rattus norvegicus
ttggaccctgacagcacagaatgga

SEQ ID NO: 680724 - DNA, 25 bp, Rattus norvegicus
ttggaccctgactgcacagaatgga

SEQ ID NO: 680725 - DNA, 25 bp, Rattus norvegicus
ttggacccttcacattcaagtggcc

SEQ ID NO: 680726 - DNA, 25 bp, Rattus norvegicus
ttggacccttcagattcaagtggcc

SEQ ID NO: 680727 - DNA, 25 bp, Rattus norvegicus
ttggaccgaccccaggagaggccac

SEQ ID NO: 680728 - DNA, 25 bp, Rattus norvegicus
ttggaccgacccgaggagaggccac

SEQ ID NO: 680729 - DNA, 25 bp, Rattus norvegicus
ttggaccgcggcatcgagtgagcta

SEQ ID NO: 680730 - DNA, 25 bp, Rattus norvegicus
ttggaccgcggcttcgagtgagcta

SEQ ID NO: 680731 - DNA, 25 bp, Rattus norvegicus
ttggacctaagcctgtgctgcagat

SEQ ID NO: 680732 - DNA, 25 bp, Rattus norvegicus
ttggacctaagcgtgtgctgcagat

SEQ ID NO: 680733 - DNA, 25 bp, Rattus norvegicus
ttggacctcaaacaagctgtggccc

SEQ ID NO: 680734 - DNA, 25 bp, Rattus norvegicus
ttggacctcaaagaagctgtggccc

SEQ ID NO: 680735 - DNA, 25 bp, Rattus norvegicus
ttggacctcggactctagagcgcat

SEQ ID NO: 680736 - DNA, 25 bp, Rattus norvegicus
ttggacctcggagtctagagcgcat

SEQ ID NO: 680737 - DNA, 25 bp, Rattus norvegicus
ttggacctctgtactgttttcttac

SEQ ID NO: 680738 - DNA, 25 bp, Rattus norvegicus
ttggacctctgttctgttttcttac

SEQ ID NO: 680739 - DNA, 25 bp, Rattus norvegicus
ttggacctgcctaataggcctggga

SEQ ID NO: 680740 - DNA, 25 bp, Rattus norvegicus
ttggacctgccttataggcctggga

SEQ ID NO: 680741 - DNA, 25 bp, Rattus norvegicus
ttggacctgctgctgtgagactgca

SEQ ID NO: 680742 - DNA, 25 bp, Rattus norvegicus
ttggacctgctggtgtgagactgca

SEQ ID NO: 680743 - DNA, 25 bp, Rattus norvegicus
ttggacctggccagaagactgattg

SEQ ID NO: 680744 - DNA, 25 bp, Rattus norvegicus
ttggacctggcctgaagactgattg

SEQ ID NO: 680745 - DNA, 25 bp, Rattus norvegicus
ttggaccttgaactcggaacgaatc

SEQ ID NO: 680746 - DNA, 25 bp, Rattus norvegicus
ttggaccttgaagtcggaacgaatc

SEQ ID NO: 680747 - DNA, 25 bp, Rattus norvegicus
ttggaccttgtcaatagcattcaca

SEQ ID NO: 680748 - DNA, 25 bp, Rattus norvegicus
ttggaccttgtcacagtcgaagctt

SEQ ID NO: 680749 - DNA, 25 bp, Rattus norvegicus
ttggaccttgtctatagcattcaca

SEQ ID NO: 680750 - DNA, 25 bp, Rattus norvegicus
ttggaccttgtctcagtcgaagctt

SEQ ID NO: 680751 - DNA, 25 bp, Rattus norvegicus
ttggacctttcaacactcaagtgca

SEQ ID NO: 680752 - DNA, 25 bp, Rattus norvegicus
ttggacctttcaccctcaagaactg

SEQ ID NO: 680753 - DNA, 25 bp, Rattus norvegicus
ttggacctttcagcctcaagaactg

SEQ ID NO: 680754 - DNA, 25 bp, Rattus norvegicus
ttggacctttcatcactcaagtgca

SEQ ID NO: 680755 - DNA, 25 bp, Rattus norvegicus
ttggacctttctatactgttacgtg

SEQ ID NO: 680756 - DNA, 25 bp, Rattus norvegicus
ttggacctttctttactgttacgtg

SEQ ID NO: 680757 - DNA, 25 bp, Rattus norvegicus
ttggacgacttactccggctgcgat

SEQ ID NO: 680758 - DNA, 25 bp, Rattus norvegicus
ttggacgacttagtccggctgcgat

SEQ ID NO: 680759 - DNA, 25 bp, Rattus norvegicus
ttggacgagatcaatcagggcgaat

SEQ ID NO: 680760 - DNA, 25 bp, Rattus norvegicus
ttggacgagatctatcagggcgaat

SEQ ID NO: 680761 - DNA, 25 bp, Rattus norvegicus
ttggacgagctgatactggattgaa

SEQ ID NO: 680762 - DNA, 25 bp, Rattus norvegicus
ttggacgagctgttactggattgaa

SEQ ID NO: 680763 - DNA, 25 bp, Rattus norvegicus
ttggacgagtggctttacaggttca

SEQ ID NO: 680764 - DNA, 25 bp, Rattus norvegicus
ttggacgagtgggtttacaggttca

SEQ ID NO: 680765 - DNA, 25 bp, Rattus norvegicus
ttggacgcaacaatgcaagcgctgt

SEQ ID NO: 680766 - DNA, 25 bp, Rattus norvegicus
ttggacgcaacattgcaagcgctgt

SEQ ID NO: 680767 - DNA, 25 bp, Rattus norvegicus
ttggacgctttgctttggagactcg

SEQ ID NO: 680768 - DNA, 25 bp, Rattus norvegicus
ttggacgctttggtttggagactcg

SEQ ID NO: 680769 - DNA, 25 bp, Rattus norvegicus
ttggacggaggcatgttccccgact

SEQ ID NO: 680770 - DNA, 25 bp, Rattus norvegicus
ttggacggaggcttgttccccgact

SEQ ID NO: 680771 - DNA, 25 bp, Rattus norvegicus
ttggacgtggccaccttcgccgcgg

SEQ ID NO: 680772 - DNA, 25 bp, Rattus norvegicus
ttggacgtggcctccttcgccgcgg

SEQ ID NO: 680773 - DNA, 25 bp, Rattus norvegicus
ttggactagtgtaactccttcatgc

SEQ ID NO: 680774 - DNA, 25 bp, Rattus norvegicus
ttggactagtgttactccttcatgc

SEQ ID NO: 680775 - DNA, 25 bp, Rattus norvegicus
ttggactcacgtccttgatccttac

SEQ ID NO: 680776 - DNA, 25 bp, Rattus norvegicus
ttggactcacgtgcttgatccttac

SEQ ID NO: 680777 - DNA, 25 bp, Rattus norvegicus
ttggactccaagctgcagatagact

SEQ ID NO: 680778 - DNA, 25 bp, Rattus norvegicus
ttggactccaaggtgcagatagact

SEQ ID NO: 680779 - DNA, 25 bp, Rattus norvegicus
ttggactccacacgctgaacactga

SEQ ID NO: 680780 - DNA, 25 bp, Rattus norvegicus
ttggactccacaggctgaacactga

SEQ ID NO: 680781 - DNA, 25 bp, Rattus norvegicus
ttggactccactactgcttgggaat

SEQ ID NO: 680782 - DNA, 25 bp, Rattus norvegicus
ttggactccactctgattcagcggc

SEQ ID NO: 680783 - DNA, 25 bp, Rattus norvegicus
ttggactccactgtgattcagcggc

SEQ ID NO: 680784 - DNA, 25 bp, Rattus norvegicus
ttggactccacttctgcttgggaat

SEQ ID NO: 680785 - DNA, 25 bp, Rattus norvegicus
ttggactcccacagtagacaggcgg

SEQ ID NO: 680786 - DNA, 25 bp, Rattus norvegicus
ttggactcccactgtagacaggcgg

SEQ ID NO: 680787 - DNA, 25 bp, Rattus norvegicus
ttggactcctgacccagtttgacag

SEQ ID NO: 680788 - DNA, 25 bp, Rattus norvegicus
ttggactcctgagccagtttgacag

SEQ ID NO: 680789 - DNA, 25 bp, Rattus norvegicus
ttggactccttacagaccagctcag

SEQ ID NO: 680790 - DNA, 25 bp, Rattus norvegicus
ttggactccttagagaccagctcag

SEQ ID NO: 680791 - DNA, 25 bp, Rattus norvegicus
ttggactcctttatactactgcctt

SEQ ID NO: 680792 - DNA, 25 bp, Rattus norvegicus
ttggactcctttatctggcgctgga

SEQ ID NO: 680793 - DNA, 25 bp, Rattus norvegicus
ttggactcctttttactactgcctt

SEQ ID NO: 680794 - DNA, 25 bp, Rattus norvegicus
ttggactcctttttctggcgctgga

SEQ ID NO: 680795 - DNA, 25 bp, Rattus norvegicus
ttggactctgatctgggccacaaag

SEQ ID NO: 680796 - DNA, 25 bp, Rattus norvegicus
ttggactctgatgtgggccacaaag

SEQ ID NO: 680797 - DNA, 25 bp, Rattus norvegicus
ttggactctgttctggagaccctgg

SEQ ID NO: 680798 - DNA, 25 bp, Rattus norvegicus
ttggactctgttgtggagaccctgg

SEQ ID NO: 680799 - DNA, 25 bp, Rattus norvegicus
ttggactcttctcacaaggtgccag

SEQ ID NO: 680800 - DNA, 25 bp, Rattus norvegicus
ttggactcttctgacaaggtgccag

SEQ ID NO: 680801 - DNA, 25 bp, Rattus norvegicus
ttggactcttgacgccatgaacgaa

SEQ ID NO: 680802 - DNA, 25 bp, Rattus norvegicus
ttggactcttgaggccatgaacgaa

SEQ ID NO: 680803 - DNA, 25 bp, Rattus norvegicus
ttggactcttgcagtggactcttgc

SEQ ID NO: 680804 - DNA, 25 bp, Rattus norvegicus
ttggactcttgctgtggactcttgc

SEQ ID NO: 680805 - DNA, 25 bp, Rattus norvegicus
ttggactgaatcatgtctcctcaca

SEQ ID NO: 680806 - DNA, 25 bp, Rattus norvegicus
ttggactgaatcttgtctcctcaca

SEQ ID NO: 680807 - DNA, 25 bp, Rattus norvegicus
ttggactgatataagctgcctcccc

SEQ ID NO: 680808 - DNA, 25 bp, Rattus norvegicus
ttggactgatattagctgcctcccc

SEQ ID NO: 680809 - DNA, 25 bp, Rattus norvegicus
ttggactgccatcaattcaaggcca

SEQ ID NO: 680810 - DNA, 25 bp, Rattus norvegicus
ttggactgccatgaattcaaggcca

SEQ ID NO: 680811 - DNA, 25 bp, Rattus norvegicus
ttggactgcctcagattatgctgat

SEQ ID NO: 680812 - DNA, 25 bp, Rattus norvegicus
ttggactgcctctgattatgctgat

SEQ ID NO: 680813 - DNA, 25 bp, Rattus norvegicus
ttggactgcggacgaccagctgaat

SEQ ID NO: 680814 - DNA, 25 bp, Rattus norvegicus
ttggactgcggaggaccagctgaat

SEQ ID NO: 680815 - DNA, 25 bp, Rattus norvegicus
ttggactggttcagctcccagaaaa

SEQ ID NO: 680816 - DNA, 25 bp, Rattus norvegicus
ttggactggttctgctcccagaaaa

SEQ ID NO: 680817 - DNA, 25 bp, Rattus norvegicus
ttggactgtatacgtacctgcactc

SEQ ID NO: 680818 - DNA, 25 bp, Rattus norvegicus
ttggactgtataggtacctgcactc

SEQ ID NO: 680819 - DNA, 25 bp, Rattus norvegicus
ttggacttaatgacacgctactaat

SEQ ID NO: 680820 - DNA, 25 bp, Rattus norvegicus
ttggacttaatgtcacgctactaat

SEQ ID NO: 680821 - DNA, 25 bp, Rattus norvegicus
ttggacttcacacctgctcctgagt

SEQ ID NO: 680822 - DNA, 25 bp, Rattus norvegicus
ttggacttcacagctgctcctgagt

SEQ ID NO: 680823 - DNA, 25 bp, Rattus norvegicus
ttggacttctccatggtaagccagt

SEQ ID NO: 680824 - DNA, 25 bp, Rattus norvegicus
ttggacttctccttggtaagccagt

SEQ ID NO: 680825 - DNA, 25 bp, Rattus norvegicus
ttggacttctgcacatcattacacg

SEQ ID NO: 680826 - DNA, 25 bp, Rattus norvegicus
ttggacttctgctcatcattacacg

SEQ ID NO: 680827 - DNA, 25 bp, Rattus norvegicus
ttggacttgtggctagcagatgaac

SEQ ID NO: 680828 - DNA, 25 bp, Rattus norvegicus
ttggacttgtgggtagcagatgaac

SEQ ID NO: 680829 - DNA, 25 bp, Rattus norvegicus
ttggactttggtatattcgaggaca

SEQ ID NO: 680830 - DNA, 25 bp, Rattus norvegicus
ttggactttggtttattcgaggaca

SEQ ID NO: 680831 - DNA, 25 bp, Rattus norvegicus
ttggagaaggcgatcagcagcatct

SEQ ID NO: 680832 - DNA, 25 bp, Rattus norvegicus
ttggagaaggcgttcagcagcatct

SEQ ID NO: 680833 - DNA, 25 bp, Rattus norvegicus
ttggagaattgactgccgtttgccc

SEQ ID NO: 680834 - DNA, 25 bp, Rattus norvegicus
ttggagaattgagtgccgtttgccc

SEQ ID NO: 680835 - DNA, 25 bp, Rattus norvegicus
ttggagacagtaaccccactgccaa

SEQ ID NO: 680836 - DNA, 25 bp, Rattus norvegicus
ttggagacagtatccccactgccaa

SEQ ID NO: 680837 - DNA, 25 bp, Rattus norvegicus
ttggagaccaaacctcagcagtgct

SEQ ID NO: 680838 - DNA, 25 bp, Rattus norvegicus
ttggagaccaaagctcagcagtgct

SEQ ID NO: 680839 - DNA, 25 bp, Rattus norvegicus
ttggagaccacgcagcctagcctgc

SEQ ID NO: 680840 - DNA, 25 bp, Rattus norvegicus
ttggagaccacggagcctagcctgc

SEQ ID NO: 680841 - DNA, 25 bp, Rattus norvegicus
ttggagaccccactgtgaccggaaa

SEQ ID NO: 680842 - DNA, 25 bp, Rattus norvegicus
ttggagaccccagtgtgaccggaaa

SEQ ID NO: 680843 - DNA, 25 bp, Rattus norvegicus
ttggagacgatcattcttctagaaa

SEQ ID NO: 680844 - DNA, 25 bp, Rattus norvegicus
ttggagacgatctttcttctagaaa

SEQ ID NO: 680845 - DNA, 25 bp, Rattus norvegicus
ttggagactttacctcttggcttac

SEQ ID NO: 680846 - DNA, 25 bp, Rattus norvegicus
ttggagactttagctcttggcttac

SEQ ID NO: 680847 - DNA, 25 bp, Rattus norvegicus
ttggagagaccccatacccttttgt

SEQ ID NO: 680848 - DNA, 25 bp, Rattus norvegicus
ttggagagacccgatacccttttgt

SEQ ID NO: 680849 - DNA, 25 bp, Rattus norvegicus
ttggagagatcaaaagctagcagct

SEQ ID NO: 680850 - DNA, 25 bp, Rattus norvegicus
ttggagagatcataagctagcagct

SEQ ID NO: 680851 - DNA, 25 bp, Rattus norvegicus
ttggagagccccaggacccagaaga

SEQ ID NO: 680852 - DNA, 25 bp, Rattus norvegicus
ttggagagccccatatgcagggact

SEQ ID NO: 680853 - DNA, 25 bp, Rattus norvegicus
ttggagagcccctggacccagaaga

SEQ ID NO: 680854 - DNA, 25 bp, Rattus norvegicus
ttggagagccccttatgcagggact

SEQ ID NO: 680855 - DNA, 25 bp, Rattus norvegicus
ttggagaggtttccagtcttccttt

SEQ ID NO: 680856 - DNA, 25 bp, Rattus norvegicus
ttggagaggtttgcagtcttccttt

SEQ ID NO: 680857 - DNA, 25 bp, Rattus norvegicus
ttggagataggaaggcgatcgcctc

SEQ ID NO: 680858 - DNA, 25 bp, Rattus norvegicus
ttggagataggatggcgatcgcctc

SEQ ID NO: 680859 - DNA, 25 bp, Rattus norvegicus
ttggagatctctaacatgccctaat

SEQ ID NO: 680860 - DNA, 25 bp, Rattus norvegicus
ttggagatctcttacatgccctaat

SEQ ID NO: 680861 - DNA, 25 bp, Rattus norvegicus
ttggagatctgtagggatgactgct

SEQ ID NO: 680862 - DNA, 25 bp, Rattus norvegicus
ttggagatctgttgggatgactgct

SEQ ID NO: 680863 - DNA, 25 bp, Rattus norvegicus
ttggagatgcttcgagcagagaaac

SEQ ID NO: 680864 - DNA, 25 bp, Rattus norvegicus
ttggagatgcttggagcagagaaac

SEQ ID NO: 680865 - DNA, 25 bp, Rattus norvegicus
ttggagatgttaattattagatgat

SEQ ID NO: 680866 - DNA, 25 bp, Rattus norvegicus
ttggagatgttatttattagatgat

SEQ ID NO: 680867 - DNA, 25 bp, Rattus norvegicus
ttggagatttccaggcgcgtcttgg

SEQ ID NO: 680868 - DNA, 25 bp, Rattus norvegicus
ttggagatttcctggcgcgtcttgg

SEQ ID NO: 680869 - DNA, 25 bp, Rattus norvegicus
ttggagattttcacacctcagggtc

SEQ ID NO: 680870 - DNA, 25 bp, Rattus norvegicus
ttggagattttctcacctcagggtc

SEQ ID NO: 680871 - DNA, 25 bp, Rattus norvegicus
ttggagcaaccacgccgggccacga

SEQ ID NO: 680872 - DNA, 25 bp, Rattus norvegicus
ttggagcaaccaggccgggccacga

SEQ ID NO: 680873 - DNA, 25 bp, Rattus norvegicus
ttggagcaatccaaggccctggagt

SEQ ID NO: 680874 - DNA, 25 bp, Rattus norvegicus
ttggagcaatcctaggccctggagt

SEQ ID NO: 680875 - DNA, 25 bp, Rattus norvegicus
ttggagcacacacaaaaggcacttg

SEQ ID NO: 680876 - DNA, 25 bp, Rattus norvegicus
ttggagcacacagaaaaggcacttg

SEQ ID NO: 680877 - DNA, 25 bp, Rattus norvegicus
ttggagcacctcacatttaaataag

SEQ ID NO: 680878 - DNA, 25 bp, Rattus norvegicus
ttggagcacctctcatttaaataag

SEQ ID NO: 680879 - DNA, 25 bp, Rattus norvegicus
ttggagcaccttactgccattcgag

SEQ ID NO: 680880 - DNA, 25 bp, Rattus norvegicus
ttggagcacctttctgccattcgag

SEQ ID NO: 680881 - DNA, 25 bp, Rattus norvegicus
ttggagcagcagagaagtcctcccc

SEQ ID NO: 680882 - DNA, 25 bp, Rattus norvegicus
ttggagcagcagtgaagtcctcccc

SEQ ID NO: 680883 - DNA, 25 bp, Rattus norvegicus
ttggagcagcccatagtcgtgcaga

SEQ ID NO: 680884 - DNA, 25 bp, Rattus norvegicus
ttggagcagcccttagtcgtgcaga

SEQ ID NO: 680885 - DNA, 25 bp, Rattus norvegicus
ttggagcaggctctcaatgaatagc

SEQ ID NO: 680886 - DNA, 25 bp, Rattus norvegicus
ttggagcaggctgtcaatgaatagc

SEQ ID NO: 680887 - DNA, 25 bp, Rattus norvegicus
ttggagcataagacctgcaagccgg

SEQ ID NO: 680888 - DNA, 25 bp, Rattus norvegicus
ttggagcataagtcctgcaagccgg

SEQ ID NO: 680889 - DNA, 25 bp, Rattus norvegicus
ttggagcatcgaccctctcggcggc

SEQ ID NO: 680890 - DNA, 25 bp, Rattus norvegicus
ttggagcatcgagcctctcggcggc

SEQ ID NO: 680891 - DNA, 25 bp, Rattus norvegicus
ttggagccacagatgatgccgccac

SEQ ID NO: 680892 - DNA, 25 bp, Rattus norvegicus
ttggagccacagttgatgccgccac

SEQ ID NO: 680893 - DNA, 25 bp, Rattus norvegicus
ttggagccagtgattgcgtgcatgc

SEQ ID NO: 680894 - DNA, 25 bp, Rattus norvegicus
ttggagccagtgtttgcgtgcatgc

SEQ ID NO: 680895 - DNA, 25 bp, Rattus norvegicus
ttggagccatcaatggaactctggc

SEQ ID NO: 680896 - DNA, 25 bp, Rattus norvegicus
ttggagccatcattggaactctggc

SEQ ID NO: 680897 - DNA, 25 bp, Rattus norvegicus
ttggagccatggacaggtcacagtc

SEQ ID NO: 680898 - DNA, 25 bp, Rattus norvegicus
ttggagccatggtcaggtcacagtc

SEQ ID NO: 680899 - DNA, 25 bp, Rattus norvegicus
ttggagccattgaactttgtgcaca

SEQ ID NO: 680900 - DNA, 25 bp, Rattus norvegicus
ttggagccattgactgagccatcag

SEQ ID NO: 680901 - DNA, 25 bp, Rattus norvegicus
ttggagccattgtactttgtgcaca

SEQ ID NO: 680902 - DNA, 25 bp, Rattus norvegicus
ttggagccattgtctgagccatcag

SEQ ID NO: 680903 - DNA, 25 bp, Rattus norvegicus
ttggagcccactactggcctctgag

SEQ ID NO: 680904 - DNA, 25 bp, Rattus norvegicus
ttggagcccacttctggcctctgag

SEQ ID NO: 680905 - DNA, 25 bp, Rattus norvegicus
ttggagcccagaagcactggaccat

SEQ ID NO: 680906 - DNA, 25 bp, Rattus norvegicus
ttggagcccagatgcactggaccat

SEQ ID NO: 680907 - DNA, 25 bp, Rattus norvegicus
ttggagccctcacgacagcatcagc

SEQ ID NO: 680908 - DNA, 25 bp, Rattus norvegicus
ttggagccctcactggatttcctgg

SEQ ID NO: 680909 - DNA, 25 bp, Rattus norvegicus
ttggagccctcaggacagcatcagc

SEQ ID NO: 680910 - DNA, 25 bp, Rattus norvegicus
ttggagccctcagtggatttcctgg

SEQ ID NO: 680911 - DNA, 25 bp, Rattus norvegicus
ttggagccctccagaacattcggta

SEQ ID NO: 680912 - DNA, 25 bp, Rattus norvegicus
ttggagccctccaggaacttagata

SEQ ID NO: 680913 - DNA, 25 bp, Rattus norvegicus
ttggagccctcctgaacattcggta

SEQ ID NO: 680914 - DNA, 25 bp, Rattus norvegicus
ttggagccctcctggaacttagata

SEQ ID NO: 680915 - DNA, 25 bp, Rattus norvegicus
ttggagccctgaatcactcacgtag

SEQ ID NO: 680916 - DNA, 25 bp, Rattus norvegicus
ttggagccctgattcactcacgtag

SEQ ID NO: 680917 - DNA, 25 bp, Rattus norvegicus
ttggagcctctgctctctgtggagc

SEQ ID NO: 680918 - DNA, 25 bp, Rattus norvegicus
ttggagcctctggtctctgtggagc

SEQ ID NO: 680919 - DNA, 25 bp, Rattus norvegicus
ttggagcctttgagactggagtcac

SEQ ID NO: 680920 - DNA, 25 bp, Rattus norvegicus
ttggagcctttgtgactggagtcac

SEQ ID NO: 680921 - DNA, 25 bp, Rattus norvegicus
ttggagcgagccactgccgggattt

SEQ ID NO: 680922 - DNA, 25 bp, Rattus norvegicus
ttggagcgagcctctgccgggattt

SEQ ID NO: 680923 - DNA, 25 bp, Rattus norvegicus
ttggagcgagtcatggtgatgccct

SEQ ID NO: 680924 - DNA, 25 bp, Rattus norvegicus
ttggagcgagtcttggtgatgccct

SEQ ID NO: 680925 - DNA, 25 bp, Rattus norvegicus
ttggagcgggtcacatggcattgta

SEQ ID NO: 680926 - DNA, 25 bp, Rattus norvegicus
ttggagcgggtctcatggcattgta

SEQ ID NO: 680927 - DNA, 25 bp, Rattus norvegicus
ttggagcgtgtcatcgagaggaccc

SEQ ID NO: 680928 - DNA, 25 bp, Rattus norvegicus
ttggagcgtgtcttcgagaggaccc

SEQ ID NO: 680929 - DNA, 25 bp, Rattus norvegicus
ttggagctagacatgggcgcattaa

SEQ ID NO: 680930 - DNA, 25 bp, Rattus norvegicus
ttggagctagacttgggcgcattaa

SEQ ID NO: 680931 - DNA, 25 bp, Rattus norvegicus
ttggagctatacagtcagggtcgac

SEQ ID NO: 680932 - DNA, 25 bp, Rattus norvegicus
ttggagctatactgtcagggtcgac

SEQ ID NO: 680933 - DNA, 25 bp, Rattus norvegicus
ttggagctatgtatggccttaccac

SEQ ID NO: 680934 - DNA, 25 bp, Rattus norvegicus
ttggagctatgtttggccttaccac

SEQ ID NO: 680935 - DNA, 25 bp, Rattus norvegicus
ttggagctcgtccagaatccatcag

SEQ ID NO: 680936 - DNA, 25 bp, Rattus norvegicus
ttggagctcgtcgagaatccatcag

SEQ ID NO: 680937 - DNA, 25 bp, Rattus norvegicus
ttggagctgagcactaccacctttt

SEQ ID NO: 680938 - DNA, 25 bp, Rattus norvegicus
ttggagctgagctctaccacctttt

SEQ ID NO: 680939 - DNA, 25 bp, Rattus norvegicus
ttggagctgcacaccgttgtgattg

SEQ ID NO: 680940 - DNA, 25 bp, Rattus norvegicus
ttggagctgcactccgttgtgattg

SEQ ID NO: 680941 - DNA, 25 bp, Rattus norvegicus
ttggagctgcctcgctaggaccccg

SEQ ID NO: 680942 - DNA, 25 bp, Rattus norvegicus
ttggagctgcctggctaggaccccg

SEQ ID NO: 680943 - DNA, 25 bp, Rattus norvegicus
ttggagctgctcatcgtgtcccagg

SEQ ID NO: 680944 - DNA, 25 bp, Rattus norvegicus
ttggagctgctcttcgtgtcccagg

SEQ ID NO: 680945 - DNA, 25 bp, Rattus norvegicus
ttggagctgtacacgtccacctcga

SEQ ID NO: 680946 - DNA, 25 bp, Rattus norvegicus
ttggagctgtactcgtccacctcga

SEQ ID NO: 680947 - DNA, 25 bp, Rattus norvegicus
ttggagcttccacggacttctgacc

SEQ ID NO: 680948 - DNA, 25 bp, Rattus norvegicus
ttggagcttccagggacttctgacc

SEQ ID NO: 680949 - DNA, 25 bp, Rattus norvegicus
ttggagctttaactgctgactgcag

SEQ ID NO: 680950 - DNA, 25 bp, Rattus norvegicus
ttggagctttaagtgctgactgcag

SEQ ID NO: 680951 - DNA, 25 bp, Rattus norvegicus
ttggagctttgcaatacccataaca

SEQ ID NO: 680952 - DNA, 25 bp, Rattus norvegicus
ttggagctttgctatacccataaca

SEQ ID NO: 680953 - DNA, 25 bp, Rattus norvegicus
ttggagctttggctgtctttgtagt

SEQ ID NO: 680954 - DNA, 25 bp, Rattus norvegicus
ttggagctttgggtgtctttgtagt

SEQ ID NO: 680955 - DNA, 25 bp, Rattus norvegicus
ttggaggacaagctggcacccttag

SEQ ID NO: 680956 - DNA, 25 bp, Rattus norvegicus
ttggaggacaaggtggcacccttag

SEQ ID NO: 680957 - DNA, 25 bp, Rattus norvegicus
ttggaggacacccagccgtctgatt

SEQ ID NO: 680958 - DNA, 25 bp, Rattus norvegicus
ttggaggacaccgagccgtctgatt

SEQ ID NO: 680959 - DNA, 25 bp, Rattus norvegicus
ttggaggacagacgtcccatcccag

SEQ ID NO: 680960 - DNA, 25 bp, Rattus norvegicus
ttggaggacagaggtcccatcccag

SEQ ID NO: 680961 - DNA, 25 bp, Rattus norvegicus
ttggaggagcacatctttctgctgc

SEQ ID NO: 680962 - DNA, 25 bp, Rattus norvegicus
ttggaggagcacttctttctgctgc

SEQ ID NO: 680963 - DNA, 25 bp, Rattus norvegicus
ttggaggagcctacttgtgtgatgt

SEQ ID NO: 680964 - DNA, 25 bp, Rattus norvegicus
ttggaggagccttcttgtgtgatgt

SEQ ID NO: 680965 - DNA, 25 bp, Rattus norvegicus
ttggaggaggtcacaggccatgtcc

SEQ ID NO: 680966 - DNA, 25 bp, Rattus norvegicus
ttggaggaggtctcaggccatgtcc

SEQ ID NO: 680967 - DNA, 25 bp, Rattus norvegicus
ttggaggcagagaccttcccagagg

SEQ ID NO: 680968 - DNA, 25 bp, Rattus norvegicus
ttggaggcagagtccttcccagagg

SEQ ID NO: 680969 - DNA, 25 bp, Rattus norvegicus
ttggaggcagcacttggacacacac

SEQ ID NO: 680970 - DNA, 25 bp, Rattus norvegicus
ttggaggcagcagttggacacacac

SEQ ID NO: 680971 - DNA, 25 bp, Rattus norvegicus
ttggaggcagctccttatcctagca

SEQ ID NO: 680972 - DNA, 25 bp, Rattus norvegicus
ttggaggcagctgcttatcctagca

SEQ ID NO: 680973 - DNA, 25 bp, Rattus norvegicus
ttggaggcaggtactagatgtgatt

SEQ ID NO: 680974 - DNA, 25 bp, Rattus norvegicus
ttggaggcaggttctagatgtgatt

SEQ ID NO: 680975 - DNA, 25 bp, Rattus norvegicus
ttggaggccaacatgtgtgctacat

SEQ ID NO: 680976 - DNA, 25 bp, Rattus norvegicus
ttggaggccaacttgtgtgctacat

SEQ ID NO: 680977 - DNA, 25 bp, Rattus norvegicus
ttggaggccaggatcgccctcatgc

SEQ ID NO: 680978 - DNA, 25 bp, Rattus norvegicus
ttggaggccaggttcgccctcatgc

SEQ ID NO: 680979 - DNA, 25 bp, Rattus norvegicus
ttggaggcgaccctgtccagcctga

SEQ ID NO: 680980 - DNA, 25 bp, Rattus norvegicus
ttggaggcgaccgtgtccagcctga

SEQ ID NO: 680981 - DNA, 25 bp, Rattus norvegicus
ttggaggcggtcacacgttaaccct

SEQ ID NO: 680982 - DNA, 25 bp, Rattus norvegicus
ttggaggcggtctcacgttaaccct

SEQ ID NO: 680983 - DNA, 25 bp, Rattus norvegicus
ttggaggctcccaaccaggaataaa

SEQ ID NO: 680984 - DNA, 25 bp, Rattus norvegicus
ttggaggctccctaccaggaataaa

SEQ ID NO: 680985 - DNA, 25 bp, Rattus norvegicus
ttggaggctcgaaatctgatctttg

SEQ ID NO: 680986 - DNA, 25 bp, Rattus norvegicus
ttggaggctcgatatctgatctttg

SEQ ID NO: 680987 - DNA, 25 bp, Rattus norvegicus
ttggaggctgtacgcaccaggcaca

SEQ ID NO: 680988 - DNA, 25 bp, Rattus norvegicus
ttggaggctgtaggcaccaggcaca

SEQ ID NO: 680989 - DNA, 25 bp, Rattus norvegicus
ttggagggacaacgttcacataaca

SEQ ID NO: 680990 - DNA, 25 bp, Rattus norvegicus
ttggagggacaaggttcacataaca

SEQ ID NO: 680991 - DNA, 25 bp, Rattus norvegicus
ttggagggaggaaccaccttggatc

SEQ ID NO: 680992 - DNA, 25 bp, Rattus norvegicus
ttggagggaggatccaccttggatc

SEQ ID NO: 680993 - DNA, 25 bp, Rattus norvegicus
ttggagggaggcacgatctctgttc

SEQ ID NO: 680994 - DNA, 25 bp, Rattus norvegicus
ttggagggaggctcgatctctgttc

SEQ ID NO: 680995 - DNA, 25 bp, Rattus norvegicus
ttggagggcaagacaactctgggta

SEQ ID NO: 680996 - DNA, 25 bp, Rattus norvegicus
ttggagggcaagtcaactctgggta

SEQ ID NO: 680997 - DNA, 25 bp, Rattus norvegicus
ttggaggtacatcatctcaccaagg

SEQ ID NO: 680998 - DNA, 25 bp, Rattus norvegicus
ttggaggtacatgatctcaccaagg

SEQ ID NO: 680999 - DNA, 25 bp, Rattus norvegicus
ttggaggtagcacagaccactgccc

SEQ ID NO: 681000 - DNA, 25 bp, Rattus norvegicus
ttggaggtagcagagaccactgccc

SEQ ID NO: 681001 - DNA, 25 bp, Rattus norvegicus
ttggaggtcacacccagttcacagc

SEQ ID NO: 681002 - DNA, 25 bp, Rattus norvegicus
ttggaggtcacagccagttcacagc

SEQ ID NO: 681003 - DNA, 25 bp, Rattus norvegicus
ttggaggtcagcactctctgagaga

SEQ ID NO: 681004 - DNA, 25 bp, Rattus norvegicus
ttggaggtcagctctctctgagaga

SEQ ID NO: 681005 - DNA, 25 bp, Rattus norvegicus
ttggaggtcctgctttctggcatca

SEQ ID NO: 681006 - DNA, 25 bp, Rattus norvegicus
ttggaggtcctggtttctggcatca

SEQ ID NO: 681007 - DNA, 25 bp, Rattus norvegicus
ttggaggtctgcacttctgtggaga

SEQ ID NO: 681008 - DNA, 25 bp, Rattus norvegicus
ttggaggtctgctcttctgtggaga

SEQ ID NO: 681009 - DNA, 25 bp, Rattus norvegicus
ttggaggtgacaacagcaatgcagt

SEQ ID NO: 681010 - DNA, 25 bp, Rattus norvegicus
ttggaggtgacatcagcaatgcagt

SEQ ID NO: 681011 - DNA, 25 bp, Rattus norvegicus
ttggaggtgactctgtcccgccctg

SEQ ID NO: 681012 - DNA, 25 bp, Rattus norvegicus
ttggaggtgactgtgtcccgccctg

SEQ ID NO: 681013 - DNA, 25 bp, Rattus norvegicus
ttggaggtggtaaccaccagcacat

SEQ ID NO: 681014 - DNA, 25 bp, Rattus norvegicus
ttggaggtggtatccaccagcacat

SEQ ID NO: 681015 - DNA, 25 bp, Rattus norvegicus
ttggaggttagacaccacgcaccat

SEQ ID NO: 681016 - DNA, 25 bp, Rattus norvegicus
ttggaggttagagaccacgcaccat

SEQ ID NO: 681017 - DNA, 25 bp, Rattus norvegicus
ttggaggttcttatgttgtgctttt

SEQ ID NO: 681018 - DNA, 25 bp, Rattus norvegicus
ttggaggttcttttgttgtgctttt

SEQ ID NO: 681019 - DNA, 25 bp, Rattus norvegicus
ttggaggttgttactcttttctgct

SEQ ID NO: 681020 - DNA, 25 bp, Rattus norvegicus
ttggaggttgtttctcttttctgct

SEQ ID NO: 681021 - DNA, 25 bp, Rattus norvegicus
ttggagtacctgactgagccctcag

SEQ ID NO: 681022 - DNA, 25 bp, Rattus norvegicus
ttggagtacctgtctgagccctcag

SEQ ID NO: 681023 - DNA, 25 bp, Rattus norvegicus
ttggagtactgcctagtccgacact

SEQ ID NO: 681024 - DNA, 25 bp, Rattus norvegicus
ttggagtactgcgtagtccgacact

SEQ ID NO: 681025 - DNA, 25 bp, Rattus norvegicus
ttggagtagctcacagacttggatt

SEQ ID NO: 681026 - DNA, 25 bp, Rattus norvegicus
ttggagtagctctcagacttggatt

SEQ ID NO: 681027 - DNA, 25 bp, Rattus norvegicus
ttggagtcacccacagaacgtatga

SEQ ID NO: 681028 - DNA, 25 bp, Rattus norvegicus
ttggagtcaccctcagaacgtatga

SEQ ID NO: 681029 - DNA, 25 bp, Rattus norvegicus
ttggagtcacttcgacatcgatgat

SEQ ID NO: 681030 - DNA, 25 bp, Rattus norvegicus
ttggagtcacttggacatcgatgat

SEQ ID NO: 681031 - DNA, 25 bp, Rattus norvegicus
ttggagtcctttaattcttctttga

SEQ ID NO: 681032 - DNA, 25 bp, Rattus norvegicus
ttggagtccttttattcttctttga

SEQ ID NO: 681033 - DNA, 25 bp, Rattus norvegicus
ttggagtctatcacggcagtcaact

SEQ ID NO: 681034 - DNA, 25 bp, Rattus norvegicus
ttggagtctatctcggcagtcaact

SEQ ID NO: 681035 - DNA, 25 bp, Rattus norvegicus
ttggagtctgagatggtcctgttcc

SEQ ID NO: 681036 - DNA, 25 bp, Rattus norvegicus
ttggagtctgagttggtcctgttcc

SEQ ID NO: 681037 - DNA, 25 bp, Rattus norvegicus
ttggagtctggcagtcacgaccgta

SEQ ID NO: 681038 - DNA, 25 bp, Rattus norvegicus
ttggagtctggctgtcacgaccgta

SEQ ID NO: 681039 - DNA, 25 bp, Rattus norvegicus
ttggagtcttccctgctgaaaatgg

SEQ ID NO: 681040 - DNA, 25 bp, Rattus norvegicus
ttggagtcttccgtgctgaaaatgg

SEQ ID NO: 681041 - DNA, 25 bp, Rattus norvegicus
ttggagttcgcacttaaataacatg

SEQ ID NO: 681042 - DNA, 25 bp, Rattus norvegicus
ttggagttcgcagttaaataacatg

SEQ ID NO: 681043 - DNA, 25 bp, Rattus norvegicus
ttggagttcgctcggttttcttgac

SEQ ID NO: 681044 - DNA, 25 bp, Rattus norvegicus
ttggagttcgctgggttttcttgac

SEQ ID NO: 681045 - DNA, 25 bp, Rattus norvegicus
ttggagttgctcagtggtacttttt

SEQ ID NO: 681046 - DNA, 25 bp, Rattus norvegicus
ttggagttgctctgtggtacttttt

SEQ ID NO: 681047 - DNA, 25 bp, Rattus norvegicus
ttggagtttcaaatgttaatggtct

SEQ ID NO: 681048 - DNA, 25 bp, Rattus norvegicus
ttggagtttcaattgttaatggtct

SEQ ID NO: 681049 - DNA, 25 bp, Rattus norvegicus
ttggagtttgaccttttcccaactg

SEQ ID NO: 681050 - DNA, 25 bp, Rattus norvegicus
ttggagtttgacgttttcccaactg

SEQ ID NO: 681051 - DNA, 25 bp, Rattus norvegicus
ttggagtttggtcttcccgcagcca

SEQ ID NO: 681052 - DNA, 25 bp, Rattus norvegicus
ttggagtttggtgttcccgcagcca

SEQ ID NO: 681053 - DNA, 25 bp, Rattus norvegicus
ttggagttttcaccatactgcttcc

SEQ ID NO: 681054 - DNA, 25 bp, Rattus norvegicus
ttggagttttcagcatactgcttcc

SEQ ID NO: 681055 - DNA, 25 bp, Rattus norvegicus
ttggatacagcaactcaccgtgaag

SEQ ID NO: 681056 - DNA, 25 bp, Rattus norvegicus
ttggatacagcatctcaccgtgaag

SEQ ID NO: 681057 - DNA, 25 bp, Rattus norvegicus
ttggatactaacattctaaggcgga

SEQ ID NO: 681058 - DNA, 25 bp, Rattus norvegicus
ttggatactaactttctaaggcgga

SEQ ID NO: 681059 - DNA, 25 bp, Rattus norvegicus
ttggatagatcaacaccttcctctg

SEQ ID NO: 681060 - DNA, 25 bp, Rattus norvegicus
ttggatagatcatcaccttcctctg

SEQ ID NO: 681061 - DNA, 25 bp, Rattus norvegicus
ttggatagccctctctctaaggctt

SEQ ID NO: 681062 - DNA, 25 bp, Rattus norvegicus
ttggatagccctgtctctaaggctt

SEQ ID NO: 681063 - DNA, 25 bp, Rattus norvegicus
ttggatagctatatcttgcctccct

SEQ ID NO: 681064 - DNA, 25 bp, Rattus norvegicus
ttggatagctatttcttgcctccct

SEQ ID NO: 681065 - DNA, 25 bp, Rattus norvegicus
ttggatagggccatggctggtcccc

SEQ ID NO: 681066 - DNA, 25 bp, Rattus norvegicus
ttggatagggccttggctggtcccc

SEQ ID NO: 681067 - DNA, 25 bp, Rattus norvegicus
ttggataggtcactcctgtcaggct

SEQ ID NO: 681068 - DNA, 25 bp, Rattus norvegicus
ttggataggtcagtcctgtcaggct

SEQ ID NO: 681069 - DNA, 25 bp, Rattus norvegicus
ttggatagtgtcacgggccttgcaa

SEQ ID NO: 681070 - DNA, 25 bp, Rattus norvegicus
ttggatagtgtctcgggccttgcaa

SEQ ID NO: 681071 - DNA, 25 bp, Rattus norvegicus
ttggatatccttagacttctgttag

SEQ ID NO: 681072 - DNA, 25 bp, Rattus norvegicus
ttggatatcctttgacttctgttag

SEQ ID NO: 681073 - DNA, 25 bp, Rattus norvegicus
ttggatcaaccaaattgcctctgtg

SEQ ID NO: 681074 - DNA, 25 bp, Rattus norvegicus
ttggatcaaccatattgcctctgtg

SEQ ID NO: 681075 - DNA, 25 bp, Rattus norvegicus
ttggatcaagctaactccacggcat

SEQ ID NO: 681076 - DNA, 25 bp, Rattus norvegicus
ttggatcaagcttactccacggcat

SEQ ID NO: 681077 - DNA, 25 bp, Rattus norvegicus
ttggatcagaggagtccctggtgcc

SEQ ID NO: 681078 - DNA, 25 bp, Rattus norvegicus
ttggatcagaggtgtccctggtgcc

SEQ ID NO: 681079 - DNA, 25 bp, Rattus norvegicus
ttggatccccttcaaaggctggaaa

SEQ ID NO: 681080 - DNA, 25 bp, Rattus norvegicus
ttggatccccttgaaaggctggaaa

SEQ ID NO: 681081 - DNA, 25 bp, Rattus norvegicus
ttggatccgcaaccaagggtccgtt

SEQ ID NO: 681082 - DNA, 25 bp, Rattus norvegicus
ttggatccgcaagcaagggtccgtt

SEQ ID NO: 681083 - DNA, 25 bp, Rattus norvegicus
ttggatccgggcattgtctccagtt

SEQ ID NO: 681084 - DNA, 25 bp, Rattus norvegicus
ttggatccgggctttgtctccagtt

SEQ ID NO: 681085 - DNA, 25 bp, Rattus norvegicus
ttggatcctaggaggtggcagcatt

SEQ ID NO: 681086 - DNA, 25 bp, Rattus norvegicus
ttggatcctaggtggtggcagcatt

SEQ ID NO: 681087 - DNA, 25 bp, Rattus norvegicus
ttggatcgcattaggcaaacgcaca

SEQ ID NO: 681088 - DNA, 25 bp, Rattus norvegicus
ttggatcgcatttggcaaacgcaca

SEQ ID NO: 681089 - DNA, 25 bp, Rattus norvegicus
ttggatctatgcatccttcagtagc

SEQ ID NO: 681090 - DNA, 25 bp, Rattus norvegicus
ttggatctatgcttccttcagtagc

SEQ ID NO: 681091 - DNA, 25 bp, Rattus norvegicus
ttggatctcattctggatgaagccc

SEQ ID NO: 681092 - DNA, 25 bp, Rattus norvegicus
ttggatctcattgtggatgaagccc

SEQ ID NO: 681093 - DNA, 25 bp, Rattus norvegicus
ttggatctcccacacacacttagtg

SEQ ID NO: 681094 - DNA, 25 bp, Rattus norvegicus
ttggatctcccagacacacttagtg

SEQ ID NO: 681095 - DNA, 25 bp, Rattus norvegicus
ttggatctctagagcttgctggcca

SEQ ID NO: 681096 - DNA, 25 bp, Rattus norvegicus
ttggatctctagtgcttgctggcca

SEQ ID NO: 681097 - DNA, 25 bp, Rattus norvegicus
ttggatctctttcctggacattcga

SEQ ID NO: 681098 - DNA, 25 bp, Rattus norvegicus
ttggatctctttgctggacattcga

SEQ ID NO: 681099 - DNA, 25 bp, Rattus norvegicus
ttggatctgaaaagcctggcggctc

SEQ ID NO: 681100 - DNA, 25 bp, Rattus norvegicus
ttggatctgaaatgcctggcggctc

SEQ ID NO: 681101 - DNA, 25 bp, Rattus norvegicus
ttggatctgctgagacaagggtttc

SEQ ID NO: 681102 - DNA, 25 bp, Rattus norvegicus
ttggatctgctgtgacaagggtttc

SEQ ID NO: 681103 - DNA, 25 bp, Rattus norvegicus
ttggatcttaggacccgcttaaaat

SEQ ID NO: 681104 - DNA, 25 bp, Rattus norvegicus
ttggatcttaggtcccgcttaaaat

SEQ ID NO: 681105 - DNA, 25 bp, Rattus norvegicus
ttggatgaagctatgcagcaccctt

SEQ ID NO: 681106 - DNA, 25 bp, Rattus norvegicus
ttggatgaagctttgcagcaccctt

SEQ ID NO: 681107 - DNA, 25 bp, Rattus norvegicus
ttggatgaccacagactgatcccca

SEQ ID NO: 681108 - DNA, 25 bp, Rattus norvegicus
ttggatgaccactgactgatcccca

SEQ ID NO: 681109 - DNA, 25 bp, Rattus norvegicus
ttggatgacccacccgacgtgatgt

SEQ ID NO: 681110 - DNA, 25 bp, Rattus norvegicus
ttggatgacccagccgacgtgatgt

SEQ ID NO: 681111 - DNA, 25 bp, Rattus norvegicus
ttggatgacctgatagacaccttag

SEQ ID NO: 681112 - DNA, 25 bp, Rattus norvegicus
ttggatgacctgttagacaccttag

SEQ ID NO: 681113 - DNA, 25 bp, Rattus norvegicus
ttggatgaggttacgcccttcctcc

SEQ ID NO: 681114 - DNA, 25 bp, Rattus norvegicus
ttggatgaggtttcgcccttcctcc

SEQ ID NO: 681115 - DNA, 25 bp, Rattus norvegicus
ttggatgatccacctttaacgtgaa

SEQ ID NO: 681116 - DNA, 25 bp, Rattus norvegicus
ttggatgatccagctttaacgtgaa

SEQ ID NO: 681117 - DNA, 25 bp, Rattus norvegicus
ttggatgcacttccaggctctcagc

SEQ ID NO: 681118 - DNA, 25 bp, Rattus norvegicus
ttggatgcacttgcaggctctcagc

SEQ ID NO: 681119 - DNA, 25 bp, Rattus norvegicus
ttggatgcagccctctgaatgacaa

SEQ ID NO: 681120 - DNA, 25 bp, Rattus norvegicus
ttggatgcagccgtctgaatgacaa

SEQ ID NO: 681121 - DNA, 25 bp, Rattus norvegicus
ttggatgcaggtatcagcctcgctc

SEQ ID NO: 681122 - DNA, 25 bp, Rattus norvegicus
ttggatgcaggtttcagcctcgctc

SEQ ID NO: 681123 - DNA, 25 bp, Rattus norvegicus
ttggatgccagtcctagcagctcag

SEQ ID NO: 681124 - DNA, 25 bp, Rattus norvegicus
ttggatgccagtgctagcagctcag

SEQ ID NO: 681125 - DNA, 25 bp, Rattus norvegicus
ttggatgccttgagtgtcaattgaa

SEQ ID NO: 681126 - DNA, 25 bp, Rattus norvegicus
ttggatgccttgtgtgtcaattgaa

SEQ ID NO: 681127 - DNA, 25 bp, Rattus norvegicus
ttggatgctcaaccctggcccagga

SEQ ID NO: 681128 - DNA, 25 bp, Rattus norvegicus
ttggatgctcaagcctggcccagga

SEQ ID NO: 681129 - DNA, 25 bp, Rattus norvegicus
ttggatgctgagctttatctggttt

SEQ ID NO: 681130 - DNA, 25 bp, Rattus norvegicus
ttggatgctgaggtttatctggttt

SEQ ID NO: 681131 - DNA, 25 bp, Rattus norvegicus
ttggatggacacaaggttgccggaa

SEQ ID NO: 681132 - DNA, 25 bp, Rattus norvegicus
ttggatggacactaggttgccggaa

SEQ ID NO: 681133 - DNA, 25 bp, Rattus norvegicus
ttggatggatgaatttccacccctc

SEQ ID NO: 681134 - DNA, 25 bp, Rattus norvegicus
ttggatggatgaccactccgggccc

SEQ ID NO: 681135 - DNA, 25 bp, Rattus norvegicus
ttggatggatgagcactccgggccc

SEQ ID NO: 681136 - DNA, 25 bp, Rattus norvegicus
ttggatggatgattttccacccctc

SEQ ID NO: 681137 - DNA, 25 bp, Rattus norvegicus
ttggatgtattcaggtcaataaagg

SEQ ID NO: 681138 - DNA, 25 bp, Rattus norvegicus
ttggatgtattctggtcaataaagg

SEQ ID NO: 681139 - DNA, 25 bp, Rattus norvegicus
ttggatgtcatgcatgccgagcaca

SEQ ID NO: 681140 - DNA, 25 bp, Rattus norvegicus
ttggatgtcatggatgccgagcaca

SEQ ID NO: 681141 - DNA, 25 bp, Rattus norvegicus
ttggatgtcattcttctctccaagc

SEQ ID NO: 681142 - DNA, 25 bp, Rattus norvegicus
ttggatgtcattgttctctccaagc

SEQ ID NO: 681143 - DNA, 25 bp, Rattus norvegicus
ttggatgtccagcaagttccaggga

SEQ ID NO: 681144 - DNA, 25 bp, Rattus norvegicus
ttggatgtccaggaagttccaggga

SEQ ID NO: 681145 - DNA, 25 bp, Rattus norvegicus
ttggatgtgctcctgaatctacttt

SEQ ID NO: 681146 - DNA, 25 bp, Rattus norvegicus
ttggatgtgctcgtgaatctacttt

SEQ ID NO: 681147 - DNA, 25 bp, Rattus norvegicus
ttggatgtggagaggcctcaccttc

SEQ ID NO: 681148 - DNA, 25 bp, Rattus norvegicus
ttggatgtggagtggcctcaccttc

SEQ ID NO: 681149 - DNA, 25 bp, Rattus norvegicus
ttggatgttaacagaattcacatga

SEQ ID NO: 681150 - DNA, 25 bp, Rattus norvegicus
ttggatgttaactgaattcacatga

SEQ ID NO: 681151 - DNA, 25 bp, Rattus norvegicus
ttggattaaagacgtgggccaccat

SEQ ID NO: 681152 - DNA, 25 bp, Rattus norvegicus
ttggattaaagaggtgggccaccat

SEQ ID NO: 681153 - DNA, 25 bp, Rattus norvegicus
ttggattaagcgcactagctgctcc

SEQ ID NO: 681154 - DNA, 25 bp, Rattus norvegicus
ttggattaagcggactagctgctcc

SEQ ID NO: 681155 - DNA, 25 bp, Rattus norvegicus
ttggattacaagcagcccgccgccg

SEQ ID NO: 681156 - DNA, 25 bp, Rattus norvegicus
ttggattacaaggagcccgccgccg

SEQ ID NO: 681157 - DNA, 25 bp, Rattus norvegicus
ttggattcaagtagggtttcccgag

SEQ ID NO: 681158 - DNA, 25 bp, Rattus norvegicus
ttggattcaagttgggtttcccgag

SEQ ID NO: 681159 - DNA, 25 bp, Rattus norvegicus
ttggattcaggtacatttaggatgc

SEQ ID NO: 681160 - DNA, 25 bp, Rattus norvegicus
ttggattcaggttcatttaggatgc

SEQ ID NO: 681161 - DNA, 25 bp, Rattus norvegicus
ttggattcccggaacaccttccatc

SEQ ID NO: 681162 - DNA, 25 bp, Rattus norvegicus
ttggattcccggtacaccttccatc

SEQ ID NO: 681163 - DNA, 25 bp, Rattus norvegicus
ttggattcctgccttcatggtcaaa

SEQ ID NO: 681164 - DNA, 25 bp, Rattus norvegicus
ttggattcctgcgttcatggtcaaa

SEQ ID NO: 681165 - DNA, 25 bp, Rattus norvegicus
ttggattccttaattcacattgcta

SEQ ID NO: 681166 - DNA, 25 bp, Rattus norvegicus
ttggattccttatttcacattgcta

SEQ ID NO: 681167 - DNA, 25 bp, Rattus norvegicus
ttggattgacggcaacacagccctg

SEQ ID NO: 681168 - DNA, 25 bp, Rattus norvegicus
ttggattgacgggaacacagccctg

SEQ ID NO: 681169 - DNA, 25 bp, Rattus norvegicus
ttggattgatgacccaccttcacct

SEQ ID NO: 681170 - DNA, 25 bp, Rattus norvegicus
ttggattgatgagccaccttcacct

SEQ ID NO: 681171 - DNA, 25 bp, Rattus norvegicus
ttggattgccgtccaagggcttgca

SEQ ID NO: 681172 - DNA, 25 bp, Rattus norvegicus
ttggattgccgtgcaagggcttgca

SEQ ID NO: 681173 - DNA, 25 bp, Rattus norvegicus
ttggattgcttcatctgttctttaa

SEQ ID NO: 681174 - DNA, 25 bp, Rattus norvegicus
ttggattgcttcttctgttctttaa

SEQ ID NO: 681175 - DNA, 25 bp, Rattus norvegicus
ttggattgtgtgaccccagaattga

SEQ ID NO: 681176 - DNA, 25 bp, Rattus norvegicus
ttggattgtgtgtccccagaattga

SEQ ID NO: 681177 - DNA, 25 bp, Rattus norvegicus
ttggatttctaaagtgagcatgcac

SEQ ID NO: 681178 - DNA, 25 bp, Rattus norvegicus
ttggatttctaatgtgagcatgcac

SEQ ID NO: 681179 - DNA, 25 bp, Rattus norvegicus
ttggatttgcacattcggtctctct

SEQ ID NO: 681180 - DNA, 25 bp, Rattus norvegicus
ttggatttgcactttcggtctctct

SEQ ID NO: 681181 - DNA, 25 bp, Rattus norvegicus
ttggatttgtttaaggccctcgcta

SEQ ID NO: 681182 - DNA, 25 bp, Rattus norvegicus
ttggatttgttttaggccctcgcta

SEQ ID NO: 681183 - DNA, 25 bp, Rattus norvegicus
ttggattttccaagccgaagcctgg

SEQ ID NO: 681184 - DNA, 25 bp, Rattus norvegicus
ttggattttccatgccgaagcctgg

SEQ ID NO: 681185 - DNA, 25 bp, Rattus norvegicus
ttggattttttacagatgcacccgc

SEQ ID NO: 681186 - DNA, 25 bp, Rattus norvegicus
ttggattttttagagatgcacccgc

SEQ ID NO: 681187 - DNA, 25 bp, Rattus norvegicus
ttggcaaaagctacttccacaggct

SEQ ID NO: 681188 - DNA, 25 bp, Rattus norvegicus
ttggcaaaagcttcttccacaggct

SEQ ID NO: 681189 - DNA, 25 bp, Rattus norvegicus
ttggcaaaatgcctcaagctcctgc

SEQ ID NO: 681190 - DNA, 25 bp, Rattus norvegicus
ttggcaaaatgcgtcaagctcctgc

SEQ ID NO: 681191 - DNA, 25 bp, Rattus norvegicus
ttggcaaactctcgctggaactggg

SEQ ID NO: 681192 - DNA, 25 bp, Rattus norvegicus
ttggcaaactctggctggaactggg

SEQ ID NO: 681193 - DNA, 25 bp, Rattus norvegicus
ttggcaaagccccaggagtcctgaa

SEQ ID NO: 681194 - DNA, 25 bp, Rattus norvegicus
ttggcaaagcccgaggagtcctgaa

SEQ ID NO: 681195 - DNA, 25 bp, Rattus norvegicus
ttggcaaatccaatgacttcatagg

SEQ ID NO: 681196 - DNA, 25 bp, Rattus norvegicus
ttggcaaatccattgacttcatagg

SEQ ID NO: 681197 - DNA, 25 bp, Rattus norvegicus
ttggcaacccaaagagcacaagatt

SEQ ID NO: 681198 - DNA, 25 bp, Rattus norvegicus
ttggcaacccaatgagcacaagatt

SEQ ID NO: 681199 - DNA, 25 bp, Rattus norvegicus
ttggcaacccctatgaaaagcagca

SEQ ID NO: 681200 - DNA, 25 bp, Rattus norvegicus
ttggcaacccctttgaaaagcagca

SEQ ID NO: 681201 - DNA, 25 bp, Rattus norvegicus
ttggcaacccggcatccaggatgtt

SEQ ID NO: 681202 - DNA, 25 bp, Rattus norvegicus
ttggcaacccgggatccaggatgtt

SEQ ID NO: 681203 - DNA, 25 bp, Rattus norvegicus
ttggcaacccttccctgagataagg

SEQ ID NO: 681204 - DNA, 25 bp, Rattus norvegicus
ttggcaacccttgcctgagataagg

SEQ ID NO: 681205 - DNA, 25 bp, Rattus norvegicus
ttggcaacggccctcgtcatggtta

SEQ ID NO: 681206 - DNA, 25 bp, Rattus norvegicus
ttggcaacggccgtcgtcatggtta

SEQ ID NO: 681207 - DNA, 25 bp, Rattus norvegicus
ttggcaagaactcgtggcttcccca

SEQ ID NO: 681208 - DNA, 25 bp, Rattus norvegicus
ttggcaagaactggtggcttcccca

SEQ ID NO: 681209 - DNA, 25 bp, Rattus norvegicus
ttggcaagcaacacttcacggaagc

SEQ ID NO: 681210 - DNA, 25 bp, Rattus norvegicus
ttggcaagcaactcttcacggaagc

SEQ ID NO: 681211 - DNA, 25 bp, Rattus norvegicus
ttggcaagcgccataactactgagc

SEQ ID NO: 681212 - DNA, 25 bp, Rattus norvegicus
ttggcaagcgccttaactactgagc

SEQ ID NO: 681213 - DNA, 25 bp, Rattus norvegicus
ttggcaagctgcaggtttgttatgc

SEQ ID NO: 681214 - DNA, 25 bp, Rattus norvegicus
ttggcaagctgctggtttgttatgc

SEQ ID NO: 681215 - DNA, 25 bp, Rattus norvegicus
ttggcaaggcccatgtaagctggtt

SEQ ID NO: 681216 - DNA, 25 bp, Rattus norvegicus
ttggcaaggcccttgtaagctggtt

SEQ ID NO: 681217 - DNA, 25 bp, Rattus norvegicus
ttggcaaggtacaccacaccatggt

SEQ ID NO: 681218 - DNA, 25 bp, Rattus norvegicus
ttggcaaggtactccacaccatggt

SEQ ID NO: 681219 - DNA, 25 bp, Rattus norvegicus
ttggcaagtctacggcaataggcta

SEQ ID NO: 681220 - DNA, 25 bp, Rattus norvegicus
ttggcaagtctagggcaataggcta

SEQ ID NO: 681221 - DNA, 25 bp, Rattus norvegicus
ttggcaatagcccttctgtatggaa

SEQ ID NO: 681222 - DNA, 25 bp, Rattus norvegicus
ttggcaatagccgttctgtatggaa

SEQ ID NO: 681223 - DNA, 25 bp, Rattus norvegicus
ttggcaatctgtcaggtgtgtcaaa

SEQ ID NO: 681224 - DNA, 25 bp, Rattus norvegicus
ttggcaatctgtgaggtgtgtcaaa

SEQ ID NO: 681225 - DNA, 25 bp, Rattus norvegicus
ttggcaatgcccacgctcaccagtt

SEQ ID NO: 681226 - DNA, 25 bp, Rattus norvegicus
ttggcaatgccctcgctcaccagtt

SEQ ID NO: 681227 - DNA, 25 bp, Rattus norvegicus
ttggcaatggccagtcaagctcggg

SEQ ID NO: 681228 - DNA, 25 bp, Rattus norvegicus
ttggcaatggcctgtcaagctcggg

SEQ ID NO: 681229 - DNA, 25 bp, Rattus norvegicus
ttggcaattcgcatcctgtcagttc

SEQ ID NO: 681230 - DNA, 25 bp, Rattus norvegicus
ttggcaattcgcttcctgtcagttc

SEQ ID NO: 681231 - DNA, 25 bp, Rattus norvegicus
ttggcacaaactccagtggctgtct

SEQ ID NO: 681232 - DNA, 25 bp, Rattus norvegicus
ttggcacaaactgcagtggctgtct

SEQ ID NO: 681233 - DNA, 25 bp, Rattus norvegicus
ttggcacaccgaatgctccatacgc

SEQ ID NO: 681234 - DNA, 25 bp, Rattus norvegicus
ttggcacaccgattgctccatacgc

SEQ ID NO: 681235 - DNA, 25 bp, Rattus norvegicus
ttggcacagcctactgctgaccaga

SEQ ID NO: 681236 - DNA, 25 bp, Rattus norvegicus
ttggcacagccttctgctgaccaga

SEQ ID NO: 681237 - DNA, 25 bp, Rattus norvegicus
ttggcacagtgaacatctctaagag

SEQ ID NO: 681238 - DNA, 25 bp, Rattus norvegicus
ttggcacagtgaaggcctgggtcac

SEQ ID NO: 681239 - DNA, 25 bp, Rattus norvegicus
ttggcacagtgatcatctctaagag

SEQ ID NO: 681240 - DNA, 25 bp, Rattus norvegicus
ttggcacagtgatggcctgggtcac

SEQ ID NO: 681241 - DNA, 25 bp, Rattus norvegicus
ttggcacagtgtatggtagcttgat

SEQ ID NO: 681242 - DNA, 25 bp, Rattus norvegicus
ttggcacagtgtttggtagcttgat

SEQ ID NO: 681243 - DNA, 25 bp, Rattus norvegicus
ttggcacatggaagcgttctccaat

SEQ ID NO: 681244 - DNA, 25 bp, Rattus norvegicus
ttggcacatggatgcgttctccaat

SEQ ID NO: 681245 - DNA, 25 bp, Rattus norvegicus
ttggcaccaaccaacaggtccagtt

SEQ ID NO: 681246 - DNA, 25 bp, Rattus norvegicus
ttggcaccaacctacaggtccagtt

SEQ ID NO: 681247 - DNA, 25 bp, Rattus norvegicus
ttggcaccaaggagctgtgggcctt

SEQ ID NO: 681248 - DNA, 25 bp, Rattus norvegicus
ttggcaccaaggtgctgtgggcctt

SEQ ID NO: 681249 - DNA, 25 bp, Rattus norvegicus
ttggcaccacacaaacttcggaatg

SEQ ID NO: 681250 - DNA, 25 bp, Rattus norvegicus
ttggcaccacacattctacaatgag

SEQ ID NO: 681251 - DNA, 25 bp, Rattus norvegicus
ttggcaccacactaacttcggaatg

SEQ ID NO: 681252 - DNA, 25 bp, Rattus norvegicus
ttggcaccacactttctacaatgag

SEQ ID NO: 681253 - DNA, 25 bp, Rattus norvegicus
ttggcaccaggcacttgattaggaa

SEQ ID NO: 681254 - DNA, 25 bp, Rattus norvegicus
ttggcaccaggctcttgattaggaa

SEQ ID NO: 681255 - DNA, 25 bp, Rattus norvegicus
ttggcaccatagcagagcatctcgg

SEQ ID NO: 681256 - DNA, 25 bp, Rattus norvegicus
ttggcaccataggagagcatctcgg

SEQ ID NO: 681257 - DNA, 25 bp, Rattus norvegicus
ttggcacccctgctgaatccttggt

SEQ ID NO: 681258 - DNA, 25 bp, Rattus norvegicus
ttggcacccctggtgaatccttggt

SEQ ID NO: 681259 - DNA, 25 bp, Rattus norvegicus
ttggcacctgtcatcgtgtggtctc

SEQ ID NO: 681260 - DNA, 25 bp, Rattus norvegicus
ttggcacctgtcttcgtgtggtctc

SEQ ID NO: 681261 - DNA, 25 bp, Rattus norvegicus
ttggcacgggcacggcaggcatgca

SEQ ID NO: 681262 - DNA, 25 bp, Rattus norvegicus
ttggcacgggcagggcaggcatgca

SEQ ID NO: 681263 - DNA, 25 bp, Rattus norvegicus
ttggcactaccccatgaacaacagt

SEQ ID NO: 681264 - DNA, 25 bp, Rattus norvegicus
ttggcactacccgatgaacaacagt

SEQ ID NO: 681265 - DNA, 25 bp, Rattus norvegicus
ttggcactactccaggactgagcat

SEQ ID NO: 681266 - DNA, 25 bp, Rattus norvegicus
ttggcactactcgaggactgagcat

SEQ ID NO: 681267 - DNA, 25 bp, Rattus norvegicus
ttggcactccaaccctttagtaagt

SEQ ID NO: 681268 - DNA, 25 bp, Rattus norvegicus
ttggcactccaagcctttagtaagt

SEQ ID NO: 681269 - DNA, 25 bp, Rattus norvegicus
ttggcactctggactacactattaa

SEQ ID NO: 681270 - DNA, 25 bp, Rattus norvegicus
ttggcactctggtctacactattaa

SEQ ID NO: 681271 - DNA, 25 bp, Rattus norvegicus
ttggcactgaaacccgaaagtccgt

SEQ ID NO: 681272 - DNA, 25 bp, Rattus norvegicus
ttggcactgaaagccgaaagtccgt

SEQ ID NO: 681273 - DNA, 25 bp, Rattus norvegicus
ttggcactgcctaaggctatacctg

SEQ ID NO: 681274 - DNA, 25 bp, Rattus norvegicus
ttggcactgccttaggctatacctg

SEQ ID NO: 681275 - DNA, 25 bp, Rattus norvegicus
ttggcactgtgtataggcattggaa

SEQ ID NO: 681276 - DNA, 25 bp, Rattus norvegicus
ttggcactgtgtttaggcattggaa

SEQ ID NO: 681277 - DNA, 25 bp, Rattus norvegicus
ttggcacttaccaaaaaatcccctg

SEQ ID NO: 681278 - DNA, 25 bp, Rattus norvegicus
ttggcacttacctaaaaatcccctg

SEQ ID NO: 681279 - DNA, 25 bp, Rattus norvegicus
ttggcacttgccaggaatggaccct

SEQ ID NO: 681280 - DNA, 25 bp, Rattus norvegicus
ttggcacttgcctggaatggaccct

SEQ ID NO: 681281 - DNA, 25 bp, Rattus norvegicus
ttggcactttcaaggccatcggaat

SEQ ID NO: 681282 - DNA, 25 bp, Rattus norvegicus
ttggcactttcatggccatcggaat

SEQ ID NO: 681283 - DNA, 25 bp, Rattus norvegicus
ttggcactttgcaccagacgcatat

SEQ ID NO: 681284 - DNA, 25 bp, Rattus norvegicus
ttggcactttgctccagacgcatat

SEQ ID NO: 681285 - DNA, 25 bp, Rattus norvegicus
ttggcagaatggacctagactccta

SEQ ID NO: 681286 - DNA, 25 bp, Rattus norvegicus
ttggcagaatggtcctagactccta

SEQ ID NO: 681287 - DNA, 25 bp, Rattus norvegicus
ttggcagacccaagagctctcataa

SEQ ID NO: 681288 - DNA, 25 bp, Rattus norvegicus
ttggcagacccatgagctctcataa

SEQ ID NO: 681289 - DNA, 25 bp, Rattus norvegicus
ttggcagaccggcagcgtgaatacc

SEQ ID NO: 681290 - DNA, 25 bp, Rattus norvegicus
ttggcagaccgggagcgtgaatacc

SEQ ID NO: 681291 - DNA, 25 bp, Rattus norvegicus
ttggcagacctgaccacttctgttt

SEQ ID NO: 681292 - DNA, 25 bp, Rattus norvegicus
ttggcagacctgtccacttctgttt

SEQ ID NO: 681293 - DNA, 25 bp, Rattus norvegicus
ttggcagactgcacactttagctac

SEQ ID NO: 681294 - DNA, 25 bp, Rattus norvegicus
ttggcagactgctcactttagctac

SEQ ID NO: 681295 - DNA, 25 bp, Rattus norvegicus
ttggcagacttcactgtacaaccgc

SEQ ID NO: 681296 - DNA, 25 bp, Rattus norvegicus
ttggcagacttctctgtacaaccgc

SEQ ID NO: 681297 - DNA, 25 bp, Rattus norvegicus
ttggcagagcttacaacgcagactt

SEQ ID NO: 681298 - DNA, 25 bp, Rattus norvegicus
ttggcagagctttcaacgcagactt

SEQ ID NO: 681299 - DNA, 25 bp, Rattus norvegicus
ttggcagagtacacgaccagcatgt

SEQ ID NO: 681300 - DNA, 25 bp, Rattus norvegicus
ttggcagagtactcgaccagcatgt

SEQ ID NO: 681301 - DNA, 25 bp, Rattus norvegicus
ttggcagcacagaacgagcatgatt

SEQ ID NO: 681302 - DNA, 25 bp, Rattus norvegicus
ttggcagcacagatcactctaaaca

SEQ ID NO: 681303 - DNA, 25 bp, Rattus norvegicus
ttggcagcacagcatattggcacaa

SEQ ID NO: 681304 - DNA, 25 bp, Rattus norvegicus
ttggcagcacaggatattggcacaa

SEQ ID NO: 681305 - DNA, 25 bp, Rattus norvegicus
ttggcagcacagtacgagcatgatt

SEQ ID NO: 681306 - DNA, 25 bp, Rattus norvegicus
ttggcagcacagttcactctaaaca

SEQ ID NO: 681307 - DNA, 25 bp, Rattus norvegicus
ttggcagcatgcagctcttcagagg

SEQ ID NO: 681308 - DNA, 25 bp, Rattus norvegicus
ttggcagcatgctgctcttcagagg

SEQ ID NO: 681309 - DNA, 25 bp, Rattus norvegicus
ttggcagcattcaaacggcgctcta

SEQ ID NO: 681310 - DNA, 25 bp, Rattus norvegicus
ttggcagcattctaacggcgctcta

SEQ ID NO: 681311 - DNA, 25 bp, Rattus norvegicus
ttggcagcattgctcaaccacctag

SEQ ID NO: 681312 - DNA, 25 bp, Rattus norvegicus
ttggcagcattggtcaaccacctag

SEQ ID NO: 681313 - DNA, 25 bp, Rattus norvegicus
ttggcagcccacaaaactggacaag

SEQ ID NO: 681314 - DNA, 25 bp, Rattus norvegicus
ttggcagcccactaaactggacaag

SEQ ID NO: 681315 - DNA, 25 bp, Rattus norvegicus
ttggcagcctctacgaacagttgcg

SEQ ID NO: 681316 - DNA, 25 bp, Rattus norvegicus
ttggcagcctcttcgaacagttgcg

SEQ ID NO: 681317 - DNA, 25 bp, Rattus norvegicus
ttggcagcctgaaccacacagcgaa

SEQ ID NO: 681318 - DNA, 25 bp, Rattus norvegicus
ttggcagcctgatccacacagcgaa

SEQ ID NO: 681319 - DNA, 25 bp, Rattus norvegicus
ttggcagcgcaacgagctcgccgac

SEQ ID NO: 681320 - DNA, 25 bp, Rattus norvegicus
ttggcagcgcaaggagctcgccgac

SEQ ID NO: 681321 - DNA, 25 bp, Rattus norvegicus
ttggcagctcacaggctgtgatgtt

SEQ ID NO: 681322 - DNA, 25 bp, Rattus norvegicus
ttggcagctcactggctgtgatgtt

SEQ ID NO: 681323 - DNA, 25 bp, Rattus norvegicus
ttggcagctcctaaatggttctgga

SEQ ID NO: 681324 - DNA, 25 bp, Rattus norvegicus
ttggcagctccttaatggttctgga

SEQ ID NO: 681325 - DNA, 25 bp, Rattus norvegicus
ttggcagctctgaaagctcctgata

SEQ ID NO: 681326 - DNA, 25 bp, Rattus norvegicus
ttggcagctctgtaagctcctgata

SEQ ID NO: 681327 - DNA, 25 bp, Rattus norvegicus
ttggcagctgcaatacccgggttct

SEQ ID NO: 681328 - DNA, 25 bp, Rattus norvegicus
ttggcagctgcattacccgggttct

SEQ ID NO: 681329 - DNA, 25 bp, Rattus norvegicus
ttggcagctgtcactaggcacgaga

SEQ ID NO: 681330 - DNA, 25 bp, Rattus norvegicus
ttggcagctgtctctaggcacgaga

SEQ ID NO: 681331 - DNA, 25 bp, Rattus norvegicus
ttggcagctttgacccttcaagtca

SEQ ID NO: 681332 - DNA, 25 bp, Rattus norvegicus
ttggcagctttgtcccttcaagtca

SEQ ID NO: 681333 - DNA, 25 bp, Rattus norvegicus
ttggcaggaaatcacttccctgatt

SEQ ID NO: 681334 - DNA, 25 bp, Rattus norvegicus
ttggcaggaaatgacttccctgatt

SEQ ID NO: 681335 - DNA, 25 bp, Rattus norvegicus
ttggcaggaccaccactagggacga

SEQ ID NO: 681336 - DNA, 25 bp, Rattus norvegicus
ttggcaggaccagcactagggacga

SEQ ID NO: 681337 - DNA, 25 bp, Rattus norvegicus
ttggcaggcatactagttcatgctt

SEQ ID NO: 681338 - DNA, 25 bp, Rattus norvegicus
ttggcaggcatagtagttcatgctt

SEQ ID NO: 681339 - DNA, 25 bp, Rattus norvegicus
ttggcagggacacattgctagagca

SEQ ID NO: 681340 - DNA, 25 bp, Rattus norvegicus
ttggcagggacagattgctagagca

SEQ ID NO: 681341 - DNA, 25 bp, Rattus norvegicus
ttggcagggactcaggatactcatc

SEQ ID NO: 681342 - DNA, 25 bp, Rattus norvegicus
ttggcagggactgaggatactcatc

SEQ ID NO: 681343 - DNA, 25 bp, Rattus norvegicus
ttggcagggtttcttccccatagaa

SEQ ID NO: 681344 - DNA, 25 bp, Rattus norvegicus
ttggcagggtttgttccccatagaa

SEQ ID NO: 681345 - DNA, 25 bp, Rattus norvegicus
ttggcaggttagagcaccggccgct

SEQ ID NO: 681346 - DNA, 25 bp, Rattus norvegicus
ttggcaggttagtgcaccggccgct

SEQ ID NO: 681347 - DNA, 25 bp, Rattus norvegicus
ttggcagtcacacaatcgggaaagc

SEQ ID NO: 681348 - DNA, 25 bp, Rattus norvegicus
ttggcagtcacacgactcgggatgt

SEQ ID NO: 681349 - DNA, 25 bp, Rattus norvegicus
ttggcagtcacagaatcgggaaagc

SEQ ID NO: 681350 - DNA, 25 bp, Rattus norvegicus
ttggcagtcacaggactcgggatgt

SEQ ID NO: 681351 - DNA, 25 bp, Rattus norvegicus
ttggcagtcgccattggatagtttg

SEQ ID NO: 681352 - DNA, 25 bp, Rattus norvegicus
ttggcagtcgcctttggatagtttg

SEQ ID NO: 681353 - DNA, 25 bp, Rattus norvegicus
ttggcagtctacctactcacgagag

SEQ ID NO: 681354 - DNA, 25 bp, Rattus norvegicus
ttggcagtctacgtactcacgagag

SEQ ID NO: 681355 - DNA, 25 bp, Rattus norvegicus
ttggcagtgccactaacagggcttt

SEQ ID NO: 681356 - DNA, 25 bp, Rattus norvegicus
ttggcagtgccagtaacagggcttt

SEQ ID NO: 681357 - DNA, 25 bp, Rattus norvegicus
ttggcagtgtttctggactcctgga

SEQ ID NO: 681358 - DNA, 25 bp, Rattus norvegicus
ttggcagtgtttgtggactcctgga

SEQ ID NO: 681359 - DNA, 25 bp, Rattus norvegicus
ttggcagttctgactcacgtagagc

SEQ ID NO: 681360 - DNA, 25 bp, Rattus norvegicus
ttggcagttctgtctcacgtagagc

SEQ ID NO: 681361 - DNA, 25 bp, Rattus norvegicus
ttggcataaaggagtgcttccactt

SEQ ID NO: 681362 - DNA, 25 bp, Rattus norvegicus
ttggcataaaggtgtgcttccactt

SEQ ID NO: 681363 - DNA, 25 bp, Rattus norvegicus
ttggcataagccctaatctgacttt

SEQ ID NO: 681364 - DNA, 25 bp, Rattus norvegicus
ttggcataagccgtaatctgacttt

SEQ ID NO: 681365 - DNA, 25 bp, Rattus norvegicus
ttggcatagccacatttccagcgtt

SEQ ID NO: 681366 - DNA, 25 bp, Rattus norvegicus
ttggcatagccagatttccagcgtt

SEQ ID NO: 681367 - DNA, 25 bp, Rattus norvegicus
ttggcatatatgacggaactggcta

SEQ ID NO: 681368 - DNA, 25 bp, Rattus norvegicus
ttggcatatatgtcggaactggcta

SEQ ID NO: 681369 - DNA, 25 bp, Rattus norvegicus
ttggcatatccgacaaccatgtggc

SEQ ID NO: 681370 - DNA, 25 bp, Rattus norvegicus
ttggcatatccgtcaaccatgtggc

SEQ ID NO: 681371 - DNA, 25 bp, Rattus norvegicus
ttggcatatgctccaggaactctct

SEQ ID NO: 681372 - DNA, 25 bp, Rattus norvegicus
ttggcatatgctgcaggaactctct

SEQ ID NO: 681373 - DNA, 25 bp, Rattus norvegicus
ttggcatcacaccttctatgtagat

SEQ ID NO: 681374 - DNA, 25 bp, Rattus norvegicus
ttggcatcacacgttctatgtagat

SEQ ID NO: 681375 - DNA, 25 bp, Rattus norvegicus
ttggcatcaccaaaaccgttggata

SEQ ID NO: 681376 - DNA, 25 bp, Rattus norvegicus
ttggcatcaccataaccgttggata

SEQ ID NO: 681377 - DNA, 25 bp, Rattus norvegicus
ttggcatcagagcagtgggacacat

SEQ ID NO: 681378 - DNA, 25 bp, Rattus norvegicus
ttggcatcagaggagtgggacacat

SEQ ID NO: 681379 - DNA, 25 bp, Rattus norvegicus
ttggcatcagccctactttcccttg

SEQ ID NO: 681380 - DNA, 25 bp, Rattus norvegicus
ttggcatcagccgtactttcccttg

SEQ ID NO: 681381 - DNA, 25 bp, Rattus norvegicus
ttggcatcatacacttggctccagt

SEQ ID NO: 681382 - DNA, 25 bp, Rattus norvegicus
ttggcatcatactcttggctccagt

SEQ ID NO: 681383 - DNA, 25 bp, Rattus norvegicus
ttggcatcatcacttgtgcccctaa

SEQ ID NO: 681384 - DNA, 25 bp, Rattus norvegicus
ttggcatcatcagttgtgcccctaa

SEQ ID NO: 681385 - DNA, 25 bp, Rattus norvegicus
ttggcatcatctatgtgcttgagcc

SEQ ID NO: 681386 - DNA, 25 bp, Rattus norvegicus
ttggcatcatctttgtgcttgagcc

SEQ ID NO: 681387 - DNA, 25 bp, Rattus norvegicus
ttggcatcatggacgtttcggtaga

SEQ ID NO: 681388 - DNA, 25 bp, Rattus norvegicus
ttggcatcatggtcgtttcggtaga

SEQ ID NO: 681389 - DNA, 25 bp, Rattus norvegicus
ttggcatccgtcaacccctggagct

SEQ ID NO: 681390 - DNA, 25 bp, Rattus norvegicus
ttggcatccgtcatgtggagagctt

SEQ ID NO: 681391 - DNA, 25 bp, Rattus norvegicus
ttggcatccgtctacccctggagct

SEQ ID NO: 681392 - DNA, 25 bp, Rattus norvegicus
ttggcatccgtcttgtggagagctt

SEQ ID NO: 681393 - DNA, 25 bp, Rattus norvegicus
ttggcatcctgcagtctttaagacc

SEQ ID NO: 681394 - DNA, 25 bp, Rattus norvegicus
ttggcatcctgctgtctttaagacc

SEQ ID NO: 681395 - DNA, 25 bp, Rattus norvegicus
ttggcatcctttagtgtctgagtca

SEQ ID NO: 681396 - DNA, 25 bp, Rattus norvegicus
ttggcatccttttgtgtctgagtca

SEQ ID NO: 681397 - DNA, 25 bp, Rattus norvegicus
ttggcatctcaaccttggctctttg

SEQ ID NO: 681398 - DNA, 25 bp, Rattus norvegicus
ttggcatctcaagcttggctctttg

SEQ ID NO: 681399 - DNA, 25 bp, Rattus norvegicus
ttggcatctcatataggacctccac

SEQ ID NO: 681400 - DNA, 25 bp, Rattus norvegicus
ttggcatctcatttaggacctccac

SEQ ID NO: 681401 - DNA, 25 bp, Rattus norvegicus
ttggcatctgcacaggtctctgggt

SEQ ID NO: 681402 - DNA, 25 bp, Rattus norvegicus
ttggcatctgcagaggtctctgggt

SEQ ID NO: 681403 - DNA, 25 bp, Rattus norvegicus
ttggcatcttgtcctacaacactat

SEQ ID NO: 681404 - DNA, 25 bp, Rattus norvegicus
ttggcatcttgtgctacaacactat

SEQ ID NO: 681405 - DNA, 25 bp, Rattus norvegicus
ttggcatgcactcaacaaatcccat

SEQ ID NO: 681406 - DNA, 25 bp, Rattus norvegicus
ttggcatgcactgaacaaatcccat

SEQ ID NO: 681407 - DNA, 25 bp, Rattus norvegicus
ttggcatggctcactgcgttcattc

SEQ ID NO: 681408 - DNA, 25 bp, Rattus norvegicus
ttggcatggctctctgcgttcattc

SEQ ID NO: 681409 - DNA, 25 bp, Rattus norvegicus
ttggcatgtccaacagttacgcaga

SEQ ID NO: 681410 - DNA, 25 bp, Rattus norvegicus
ttggcatgtccatcagttacgcaga

SEQ ID NO: 681411 - DNA, 25 bp, Rattus norvegicus
ttggcatgtgccactttctatggaa

SEQ ID NO: 681412 - DNA, 25 bp, Rattus norvegicus
ttggcatgtgcctctttctatggaa

SEQ ID NO: 681413 - DNA, 25 bp, Rattus norvegicus
ttggcatgtgtcctgctttgtaaca

SEQ ID NO: 681414 - DNA, 25 bp, Rattus norvegicus
ttggcatgtgtcgtgctttgtaaca

SEQ ID NO: 681415 - DNA, 25 bp, Rattus norvegicus
ttggcatgttcactgtttgcgtaca

SEQ ID NO: 681416 - DNA, 25 bp, Rattus norvegicus
ttggcatgttcagtgtttgcgtaca

SEQ ID NO: 681417 - DNA, 25 bp, Rattus norvegicus
ttggcattcggcagcatcacaagat

SEQ ID NO: 681418 - DNA, 25 bp, Rattus norvegicus
ttggcattcggctgcatcacaagat

SEQ ID NO: 681419 - DNA, 25 bp, Rattus norvegicus
ttggcattgccaaaggcctccagag

SEQ ID NO: 681420 - DNA, 25 bp, Rattus norvegicus
ttggcattgccataggcctccagag

SEQ ID NO: 681421 - DNA, 25 bp, Rattus norvegicus
ttggcattgtgacatccccatggca

SEQ ID NO: 681422 - DNA, 25 bp, Rattus norvegicus
ttggcattgtgagatccccatggca

SEQ ID NO: 681423 - DNA, 25 bp, Rattus norvegicus
ttggcatttccccattccatgaata

SEQ ID NO: 681424 - DNA, 25 bp, Rattus norvegicus
ttggcatttcccgattccatgaata

SEQ ID NO: 681425 - DNA, 25 bp, Rattus norvegicus
ttggcatttcttctttccaggcttg

SEQ ID NO: 681426 - DNA, 25 bp, Rattus norvegicus
ttggcatttcttgtttccaggcttg

SEQ ID NO: 681427 - DNA, 25 bp, Rattus norvegicus
ttggcatttgggagtcaacgccctc

SEQ ID NO: 681428 - DNA, 25 bp, Rattus norvegicus
ttggcatttgggtgtcaacgccctc

SEQ ID NO: 681429 - DNA, 25 bp, Rattus norvegicus
ttggccaaacatatgtcggaggtct

SEQ ID NO: 681430 - DNA, 25 bp, Rattus norvegicus
ttggccaaacatttgtcggaggtct

SEQ ID NO: 681431 - DNA, 25 bp, Rattus norvegicus
ttggccaaacgaacattagcagtct

SEQ ID NO: 681432 - DNA, 25 bp, Rattus norvegicus
ttggccaaacgatcattagcagtct

SEQ ID NO: 681433 - DNA, 25 bp, Rattus norvegicus
ttggccaaactcagggaagaccttt

SEQ ID NO: 681434 - DNA, 25 bp, Rattus norvegicus
ttggccaaactctgggaagaccttt

SEQ ID NO: 681435 - DNA, 25 bp, Rattus norvegicus
ttggccaacttgaccggtttttatg

SEQ ID NO: 681436 - DNA, 25 bp, Rattus norvegicus
ttggccaacttgtccggtttttatg

SEQ ID NO: 681437 - DNA, 25 bp, Rattus norvegicus
ttggccaagaacaaccacttcacag

SEQ ID NO: 681438 - DNA, 25 bp, Rattus norvegicus
ttggccaagaactaccacttcacag

SEQ ID NO: 681439 - DNA, 25 bp, Rattus norvegicus
ttggccaagtggcatggtccccttt

SEQ ID NO: 681440 - DNA, 25 bp, Rattus norvegicus
ttggccaagtgggatggtccccttt

SEQ ID NO: 681441 - DNA, 25 bp, Rattus norvegicus
ttggccaatcagcaaactcgggacc

SEQ ID NO: 681442 - DNA, 25 bp, Rattus norvegicus
ttggccaatcaggaaactcgggacc

SEQ ID NO: 681443 - DNA, 25 bp, Rattus norvegicus
ttggccaatggcaaaaacggtgaaa

SEQ ID NO: 681444 - DNA, 25 bp, Rattus norvegicus
ttggccaatggctaaaacggtgaaa

SEQ ID NO: 681445 - DNA, 25 bp, Rattus norvegicus
ttggccaattctatagtgcttccct

SEQ ID NO: 681446 - DNA, 25 bp, Rattus norvegicus
ttggccaattctttagtgcttccct

SEQ ID NO: 681447 - DNA, 25 bp, Rattus norvegicus
ttggccacaccaattgtcacatgaa

SEQ ID NO: 681448 - DNA, 25 bp, Rattus norvegicus
ttggccacaccatttgtcacatgaa

SEQ ID NO: 681449 - DNA, 25 bp, Rattus norvegicus
ttggccacactgagctcattgcaga

SEQ ID NO: 681450 - DNA, 25 bp, Rattus norvegicus
ttggccacactgtgctcattgcaga

SEQ ID NO: 681451 - DNA, 25 bp, Rattus norvegicus
ttggccacagcaaggatgtcgttgg

SEQ ID NO: 681452 - DNA, 25 bp, Rattus norvegicus
ttggccacagcacggctcatgatga

SEQ ID NO: 681453 - DNA, 25 bp, Rattus norvegicus
ttggccacagcagggctcatgatga

SEQ ID NO: 681454 - DNA, 25 bp, Rattus norvegicus
ttggccacagcatggatgtcgttgg

SEQ ID NO: 681455 - DNA, 25 bp, Rattus norvegicus
ttggccacatcaacaaggacactgt

SEQ ID NO: 681456 - DNA, 25 bp, Rattus norvegicus
ttggccacatcatcaaggacactgt

SEQ ID NO: 681457 - DNA, 25 bp, Rattus norvegicus
ttggccacatggatttctgctgcta

SEQ ID NO: 681458 - DNA, 25 bp, Rattus norvegicus
ttggccacatggttttctgctgcta

SEQ ID NO: 681459 - DNA, 25 bp, Rattus norvegicus
ttggccaccaacaaaaacctgtttg

SEQ ID NO: 681460 - DNA, 25 bp, Rattus norvegicus
ttggccaccaactaaaacctgtttg

SEQ ID NO: 681461 - DNA, 25 bp, Rattus norvegicus
ttggccaccagactatgccagggtg

SEQ ID NO: 681462 - DNA, 25 bp, Rattus norvegicus
ttggccaccagagtatgccagggtg

SEQ ID NO: 681463 - DNA, 25 bp, Rattus norvegicus
ttggccaccagcctgatgactgatt

SEQ ID NO: 681464 - DNA, 25 bp, Rattus norvegicus
ttggccaccagcgtgatgactgatt

SEQ ID NO: 681465 - DNA, 25 bp, Rattus norvegicus
ttggccaccataaattgaactgctt

SEQ ID NO: 681466 - DNA, 25 bp, Rattus norvegicus
ttggccaccatatattgaactgctt

SEQ ID NO: 681467 - DNA, 25 bp, Rattus norvegicus
ttggccaccgagaaacacattagta

SEQ ID NO: 681468 - DNA, 25 bp, Rattus norvegicus
ttggccaccgagtaacacattagta

SEQ ID NO: 681469 - DNA, 25 bp, Rattus norvegicus
ttggccaccgtacggttgaatccca

SEQ ID NO: 681470 - DNA, 25 bp, Rattus norvegicus
ttggccaccgtagggttgaatccca

SEQ ID NO: 681471 - DNA, 25 bp, Rattus norvegicus
ttggccaccgttcgactgcagcagt

SEQ ID NO: 681472 - DNA, 25 bp, Rattus norvegicus
ttggccaccgttggactgcagcagt

SEQ ID NO: 681473 - DNA, 25 bp, Rattus norvegicus
ttggccacctgtctcagcaagtcaa

SEQ ID NO: 681474 - DNA, 25 bp, Rattus norvegicus
ttggccacctgtgtcagcaagtcaa

SEQ ID NO: 681475 - DNA, 25 bp, Rattus norvegicus
ttggccaccttgagcgaagttatct

SEQ ID NO: 681476 - DNA, 25 bp, Rattus norvegicus
ttggccaccttgtgcgaagttatct

SEQ ID NO: 681477 - DNA, 25 bp, Rattus norvegicus
ttggccacgcaaagaactttacacc

SEQ ID NO: 681478 - DNA, 25 bp, Rattus norvegicus
ttggccacgcaatgaactttacacc

SEQ ID NO: 681479 - DNA, 25 bp, Rattus norvegicus
ttggccactaagactgcagttgttt

SEQ ID NO: 681480 - DNA, 25 bp, Rattus norvegicus
ttggccactaagtctgcagttgttt

SEQ ID NO: 681481 - DNA, 25 bp, Rattus norvegicus
ttggccactcaactcttttgttatc

SEQ ID NO: 681482 - DNA, 25 bp, Rattus norvegicus
ttggccactcaagtcttttgttatc

SEQ ID NO: 681483 - DNA, 25 bp, Rattus norvegicus
ttggccactgtacttgctagtttac

SEQ ID NO: 681484 - DNA, 25 bp, Rattus norvegicus
ttggccactgtagttgctagtttac

SEQ ID NO: 681485 - DNA, 25 bp, Rattus norvegicus
ttggccagctatatcagaccgaaca

SEQ ID NO: 681486 - DNA, 25 bp, Rattus norvegicus
ttggccagctatttcagaccgaaca

SEQ ID NO: 681487 - DNA, 25 bp, Rattus norvegicus
ttggccaggaaccttcacgcaggaa

SEQ ID NO: 681488 - DNA, 25 bp, Rattus norvegicus
ttggccaggaacgttcacgcaggaa

SEQ ID NO: 681489 - DNA, 25 bp, Rattus norvegicus
ttggccaggcctcattactactgaa

SEQ ID NO: 681490 - DNA, 25 bp, Rattus norvegicus
ttggccaggcctgattactactgaa

SEQ ID NO: 681491 - DNA, 25 bp, Rattus norvegicus
ttggccaggcgcacccaaagggaaa

SEQ ID NO: 681492 - DNA, 25 bp, Rattus norvegicus
ttggccaggcgctcccaaagggaaa

SEQ ID NO: 681493 - DNA, 25 bp, Rattus norvegicus
ttggccaggctcatcgaggatcctc

SEQ ID NO: 681494 - DNA, 25 bp, Rattus norvegicus
ttggccaggctcttcgaggatcctc

SEQ ID NO: 681495 - DNA, 25 bp, Rattus norvegicus
ttggccagggctatggagacgctct

SEQ ID NO: 681496 - DNA, 25 bp, Rattus norvegicus
ttggccagggctttggagacgctct

SEQ ID NO: 681497 - DNA, 25 bp, Rattus norvegicus
ttggccagtccgaaccaaagccata

SEQ ID NO: 681498 - DNA, 25 bp, Rattus norvegicus
ttggccagtccgtaccaaagccata

SEQ ID NO: 681499 - DNA, 25 bp, Rattus norvegicus
ttggccagtgccacattgtgtatta

SEQ ID NO: 681500 - DNA, 25 bp, Rattus norvegicus
ttggccagtgcctcattgtgtatta

SEQ ID NO: 681501 - DNA, 25 bp, Rattus norvegicus
ttggccagttgtcacaatccatcct

SEQ ID NO: 681502 - DNA, 25 bp, Rattus norvegicus
ttggccagttgtgacaatccatcct

SEQ ID NO: 681503 - DNA, 25 bp, Rattus norvegicus
ttggccatagagaacactgcctgcc

SEQ ID NO: 681504 - DNA, 25 bp, Rattus norvegicus
ttggccatagagtacactgcctgcc

SEQ ID NO: 681505 - DNA, 25 bp, Rattus norvegicus
ttggccatatctcatgaggctcatg

SEQ ID NO: 681506 - DNA, 25 bp, Rattus norvegicus
ttggccatatctgatgaggctcatg

SEQ ID NO: 681507 - DNA, 25 bp, Rattus norvegicus
ttggccatcacgatgtcctgcatag

SEQ ID NO: 681508 - DNA, 25 bp, Rattus norvegicus
ttggccatcacgttgtcctgcatag

SEQ ID NO: 681509 - DNA, 25 bp, Rattus norvegicus
ttggccatccagactagccgaaata

SEQ ID NO: 681510 - DNA, 25 bp, Rattus norvegicus
ttggccatccagtctagccgaaata

SEQ ID NO: 681511 - DNA, 25 bp, Rattus norvegicus
ttggccatcctgaggttcatcgtga

SEQ ID NO: 681512 - DNA, 25 bp, Rattus norvegicus
ttggccatcctgtggttcatcgtga

SEQ ID NO: 681513 - DNA, 25 bp, Rattus norvegicus
ttggccatcgggagcctggcagcac

SEQ ID NO: 681514 - DNA, 25 bp, Rattus norvegicus
ttggccatcgggtgcctggcagcac

SEQ ID NO: 681515 - DNA, 25 bp, Rattus norvegicus
ttggccatctacagcctgcatgcag

SEQ ID NO: 681516 - DNA, 25 bp, Rattus norvegicus
ttggccatctacagtactcggaagt

SEQ ID NO: 681517 - DNA, 25 bp, Rattus norvegicus
ttggccatctactgcctgcatgcag

SEQ ID NO: 681518 - DNA, 25 bp, Rattus norvegicus
ttggccatctactgtactcggaagt

SEQ ID NO: 681519 - DNA, 25 bp, Rattus norvegicus
ttggccatgaagaattgccttctgt

SEQ ID NO: 681520 - DNA, 25 bp, Rattus norvegicus
ttggccatgaagtattgccttctgt

SEQ ID NO: 681521 - DNA, 25 bp, Rattus norvegicus
ttggccatgattcctgttccacaat

SEQ ID NO: 681522 - DNA, 25 bp, Rattus norvegicus
ttggccatgattgctgttccacaat

SEQ ID NO: 681523 - DNA, 25 bp, Rattus norvegicus
ttggccatggtcctggtacccactg

SEQ ID NO: 681524 - DNA, 25 bp, Rattus norvegicus
ttggccatggtcgtggtacccactg

SEQ ID NO: 681525 - DNA, 25 bp, Rattus norvegicus
ttggccatgtaacaaggtgcactgt

SEQ ID NO: 681526 - DNA, 25 bp, Rattus norvegicus
ttggccatgtaagaaggtgcactgt

SEQ ID NO: 681527 - DNA, 25 bp, Rattus norvegicus
ttggccatgtggctgcataaaagca

SEQ ID NO: 681528 - DNA, 25 bp, Rattus norvegicus
ttggccatgtgggtgcataaaagca

SEQ ID NO: 681529 - DNA, 25 bp, Rattus norvegicus
ttggccattcttcactatttcatcg

SEQ ID NO: 681530 - DNA, 25 bp, Rattus norvegicus
ttggccattcttgactatttcatcg

SEQ ID NO: 681531 - DNA, 25 bp, Rattus norvegicus
ttggccattttcaaaaccagcaata

SEQ ID NO: 681532 - DNA, 25 bp, Rattus norvegicus
ttggccattttctaaaccagcaata

SEQ ID NO: 681533 - DNA, 25 bp, Rattus norvegicus
ttggcccaaaccagaatcatcctct

SEQ ID NO: 681534 - DNA, 25 bp, Rattus norvegicus
ttggcccaaacctgaatcatcctct

SEQ ID NO: 681535 - DNA, 25 bp, Rattus norvegicus
ttggcccaacacctagctcaacatg

SEQ ID NO: 681536 - DNA, 25 bp, Rattus norvegicus
ttggcccaacacgtagctcaacatg

SEQ ID NO: 681537 - DNA, 25 bp, Rattus norvegicus
ttggcccaactgctttttggtcttg

SEQ ID NO: 681538 - DNA, 25 bp, Rattus norvegicus
ttggcccaactggtttttggtcttg

SEQ ID NO: 681539 - DNA, 25 bp, Rattus norvegicus
ttggcccaatgcatagactgtacag

SEQ ID NO: 681540 - DNA, 25 bp, Rattus norvegicus
ttggcccaatgcttagactgtacag

SEQ ID NO: 681541 - DNA, 25 bp, Rattus norvegicus
ttggcccacctcaagcggcaaggca

SEQ ID NO: 681542 - DNA, 25 bp, Rattus norvegicus
ttggcccacctctagcggcaaggca

SEQ ID NO: 681543 - DNA, 25 bp, Rattus norvegicus
ttggcccagaagcagtcgttaagtg

SEQ ID NO: 681544 - DNA, 25 bp, Rattus norvegicus
ttggcccagaaggagtcgttaagtg

SEQ ID NO: 681545 - DNA, 25 bp, Rattus norvegicus
ttggcccaggctcagatacagttga

SEQ ID NO: 681546 - DNA, 25 bp, Rattus norvegicus
ttggcccaggctgagatacagttga

SEQ ID NO: 681547 - DNA, 25 bp, Rattus norvegicus
ttggcccagtacatagagcagcacc

SEQ ID NO: 681548 - DNA, 25 bp, Rattus norvegicus
ttggcccagtacttagagcagcacc

SEQ ID NO: 681549 - DNA, 25 bp, Rattus norvegicus
ttggcccagtggactggttctaagt

SEQ ID NO: 681550 - DNA, 25 bp, Rattus norvegicus
ttggcccagtggtctggttctaagt

SEQ ID NO: 681551 - DNA, 25 bp, Rattus norvegicus
ttggcccataggcaatgacattctt

SEQ ID NO: 681552 - DNA, 25 bp, Rattus norvegicus
ttggcccatagggaatgacattctt

SEQ ID NO: 681553 - DNA, 25 bp, Rattus norvegicus
ttggccccaatgcatgggagtgcat

SEQ ID NO: 681554 - DNA, 25 bp, Rattus norvegicus
ttggccccaatggatgggagtgcat

SEQ ID NO: 681555 - DNA, 25 bp, Rattus norvegicus
ttggccccagctccgtctggaagct

SEQ ID NO: 681556 - DNA, 25 bp, Rattus norvegicus
ttggccccagctgcgtctggaagct

SEQ ID NO: 681557 - DNA, 25 bp, Rattus norvegicus
ttggccccatgcctcaagcagtaag

SEQ ID NO: 681558 - DNA, 25 bp, Rattus norvegicus
ttggccccatgcgtcaagcagtaag

SEQ ID NO: 681559 - DNA, 25 bp, Rattus norvegicus
ttggcccccagacctttaaagtctc

SEQ ID NO: 681560 - DNA, 25 bp, Rattus norvegicus
ttggcccccagagctttaaagtctc

SEQ ID NO: 681561 - DNA, 25 bp, Rattus norvegicus
ttggcccctctgcagcagacacttt

SEQ ID NO: 681562 - DNA, 25 bp, Rattus norvegicus
ttggcccctctggagcagacacttt

SEQ ID NO: 681563 - DNA, 25 bp, Rattus norvegicus
ttggccccttatatgaatactatag

SEQ ID NO: 681564 - DNA, 25 bp, Rattus norvegicus
ttggccccttatttgaatactatag

SEQ ID NO: 681565 - DNA, 25 bp, Rattus norvegicus
ttggccccttggcacagatggcttt

SEQ ID NO: 681566 - DNA, 25 bp, Rattus norvegicus
ttggccccttgggacagatggcttt

SEQ ID NO: 681567 - DNA, 25 bp, Rattus norvegicus
ttggccccttttatctatggattat

SEQ ID NO: 681568 - DNA, 25 bp, Rattus norvegicus
ttggccccttttttctatggattat

SEQ ID NO: 681569 - DNA, 25 bp, Rattus norvegicus
ttggcccgaggacgacctgaagtca

SEQ ID NO: 681570 - DNA, 25 bp, Rattus norvegicus
ttggcccgaggaggacctgaagtca

SEQ ID NO: 681571 - DNA, 25 bp, Rattus norvegicus
ttggcccgcagcctgaagaccaaca

SEQ ID NO: 681572 - DNA, 25 bp, Rattus norvegicus
ttggcccgcagcgtgaagaccaaca

SEQ ID NO: 681573 - DNA, 25 bp, Rattus norvegicus
ttggcccgtcccaggtgtcgcagag

SEQ ID NO: 681574 - DNA, 25 bp, Rattus norvegicus
ttggcccgtccctggtgtcgcagag

SEQ ID NO: 681575 - DNA, 25 bp, Rattus norvegicus
ttggccctataacttctttaaatat

SEQ ID NO: 681576 - DNA, 25 bp, Rattus norvegicus
ttggccctataagttctttaaatat

SEQ ID NO: 681577 - DNA, 25 bp, Rattus norvegicus
ttggccctccagaataaggtccttg

SEQ ID NO: 681578 - DNA, 25 bp, Rattus norvegicus
ttggccctccagtataaggtccttg

SEQ ID NO: 681579 - DNA, 25 bp, Rattus norvegicus
ttggccctccctcaggtagataact

SEQ ID NO: 681580 - DNA, 25 bp, Rattus norvegicus
ttggccctccctgaggtagataact

SEQ ID NO: 681581 - DNA, 25 bp, Rattus norvegicus
ttggccctcctaacatatatggtaa

SEQ ID NO: 681582 - DNA, 25 bp, Rattus norvegicus
ttggccctcctatcatatatggtaa

SEQ ID NO: 681583 - DNA, 25 bp, Rattus norvegicus
ttggccctccttcgtaaggatcact

SEQ ID NO: 681584 - DNA, 25 bp, Rattus norvegicus
ttggccctccttggtaaggatcact

SEQ ID NO: 681585 - DNA, 25 bp, Rattus norvegicus
ttggccctcggcagcattaaatgta

SEQ ID NO: 681586 - DNA, 25 bp, Rattus norvegicus
ttggccctcggctgcattaaatgta

SEQ ID NO: 681587 - DNA, 25 bp, Rattus norvegicus
ttggccctcttcaatacatcagtga

SEQ ID NO: 681588 - DNA, 25 bp, Rattus norvegicus
ttggccctcttctatacatcagtga

SEQ ID NO: 681589 - DNA, 25 bp, Rattus norvegicus
ttggccctgattaaccctctggaga

SEQ ID NO: 681590 - DNA, 25 bp, Rattus norvegicus
ttggccctgatttaccctctggaga

SEQ ID NO: 681591 - DNA, 25 bp, Rattus norvegicus
ttggccctggagcacaaggagacac

SEQ ID NO: 681592 - DNA, 25 bp, Rattus norvegicus
ttggccctggaggacaaggagacac

SEQ ID NO: 681593 - DNA, 25 bp, Rattus norvegicus
ttggccctgttcagtgaccccggta

SEQ ID NO: 681594 - DNA, 25 bp, Rattus norvegicus
ttggccctgttctgtgaccccggta

SEQ ID NO: 681595 - DNA, 25 bp, Rattus norvegicus
ttggcccttgaaaactttccagtct

SEQ ID NO: 681596 - DNA, 25 bp, Rattus norvegicus
ttggcccttgaatactttccagtct

SEQ ID NO: 681597 - DNA, 25 bp, Rattus norvegicus
ttggcccttggaatgattcaaaccc

SEQ ID NO: 681598 - DNA, 25 bp, Rattus norvegicus
ttggcccttggattgattcaaaccc

SEQ ID NO: 681599 - DNA, 25 bp, Rattus norvegicus
ttggcccttgtgaacagtaatagaa

SEQ ID NO: 681600 - DNA, 25 bp, Rattus norvegicus
ttggcccttgtgtacagtaatagaa

SEQ ID NO: 681601 - DNA, 25 bp, Rattus norvegicus
ttggccctttaaacctacatgatga

SEQ ID NO: 681602 - DNA, 25 bp, Rattus norvegicus
ttggccctttaatcctacatgatga

SEQ ID NO: 681603 - DNA, 25 bp, Rattus norvegicus
ttggccctttatcgtggccggcaaa

SEQ ID NO: 681604 - DNA, 25 bp, Rattus norvegicus
ttggccctttatggtggccggcaaa

SEQ ID NO: 681605 - DNA, 25 bp, Rattus norvegicus
ttggccgaaagactggacaagcacc

SEQ ID NO: 681606 - DNA, 25 bp, Rattus norvegicus
ttggccgaaagagtggacaagcacc

SEQ ID NO: 681607 - DNA, 25 bp, Rattus norvegicus
ttggccgaactgctgatgctgtcta

SEQ ID NO: 681608 - DNA, 25 bp, Rattus norvegicus
ttggccgaactggtgatgctgtcta

SEQ ID NO: 681609 - DNA, 25 bp, Rattus norvegicus
ttggccgacctccaaatgctgagga

SEQ ID NO: 681610 - DNA, 25 bp, Rattus norvegicus
ttggccgacctcgaaatgctgagga

SEQ ID NO: 681611 - DNA, 25 bp, Rattus norvegicus
ttggccgatgccagtgcccaggtta

SEQ ID NO: 681612 - DNA, 25 bp, Rattus norvegicus
ttggccgatgcctgtgcccaggtta

SEQ ID NO: 681613 - DNA, 25 bp, Rattus norvegicus
ttggccgcattgacatctacattga

SEQ ID NO: 681614 - DNA, 25 bp, Rattus norvegicus
ttggccgcattgtcatctacattga

SEQ ID NO: 681615 - DNA, 25 bp, Rattus norvegicus
ttggccgccgctagggacagcatgt

SEQ ID NO: 681616 - DNA, 25 bp, Rattus norvegicus
ttggccgccgctccgcatggaaagc

SEQ ID NO: 681617 - DNA, 25 bp, Rattus norvegicus
ttggccgccgctgcgcatggaaagc

SEQ ID NO: 681618 - DNA, 25 bp, Rattus norvegicus
ttggccgccgcttgggacagcatgt

SEQ ID NO: 681619 - DNA, 25 bp, Rattus norvegicus
ttggccgcctggactccgagggaat

SEQ ID NO: 681620 - DNA, 25 bp, Rattus norvegicus
ttggccgcctggtctccgagggaat

SEQ ID NO: 681621 - DNA, 25 bp, Rattus norvegicus
ttggccgctagtacctaagttgaat

SEQ ID NO: 681622 - DNA, 25 bp, Rattus norvegicus
ttggccgctagttcctaagttgaat

SEQ ID NO: 681623 - DNA, 25 bp, Rattus norvegicus
ttggccgctctgaggatgagattct

SEQ ID NO: 681624 - DNA, 25 bp, Rattus norvegicus
ttggccgctctgtggatgagattct

SEQ ID NO: 681625 - DNA, 25 bp, Rattus norvegicus
ttggccgcttccagaaggctgcatt

SEQ ID NO: 681626 - DNA, 25 bp, Rattus norvegicus
ttggccgcttcctgaaggctgcatt

SEQ ID NO: 681627 - DNA, 25 bp, Rattus norvegicus
ttggccggaaagcatccctgaccag

SEQ ID NO: 681628 - DNA, 25 bp, Rattus norvegicus
ttggccggaaaggatccctgaccag

SEQ ID NO: 681629 - DNA, 25 bp, Rattus norvegicus
ttggccggcacacctgacggcaata

SEQ ID NO: 681630 - DNA, 25 bp, Rattus norvegicus
ttggccggcacagctgacggcaata

SEQ ID NO: 681631 - DNA, 25 bp, Rattus norvegicus
ttggccgtacctcctctagaatatt

SEQ ID NO: 681632 - DNA, 25 bp, Rattus norvegicus
ttggccgtacctgctctagaatatt

SEQ ID NO: 681633 - DNA, 25 bp, Rattus norvegicus
ttggccgtccagaccaggccgcaga

SEQ ID NO: 681634 - DNA, 25 bp, Rattus norvegicus
ttggccgtccagtccaggccgcaga

SEQ ID NO: 681635 - DNA, 25 bp, Rattus norvegicus
ttggccgtggttacagcgactggaa

SEQ ID NO: 681636 - DNA, 25 bp, Rattus norvegicus
ttggccgtggttagcattttttaag

SEQ ID NO: 681637 - DNA, 25 bp, Rattus norvegicus
ttggccgtggtttcagcgactggaa

SEQ ID NO: 681638 - DNA, 25 bp, Rattus norvegicus
ttggccgtggtttgcattttttaag

SEQ ID NO: 681639 - DNA, 25 bp, Rattus norvegicus
ttggccgtgtaactggaaagcacca

SEQ ID NO: 681640 - DNA, 25 bp, Rattus norvegicus
ttggccgtgtaagtggaaagcacca

SEQ ID NO: 681641 - DNA, 25 bp, Rattus norvegicus
ttggcctacatactcctagggcaaa

SEQ ID NO: 681642 - DNA, 25 bp, Rattus norvegicus
ttggcctacatagtcctagggcaaa

SEQ ID NO: 681643 - DNA, 25 bp, Rattus norvegicus
ttggcctactatacacttatcactg

SEQ ID NO: 681644 - DNA, 25 bp, Rattus norvegicus
ttggcctactattcacttatcactg

SEQ ID NO: 681645 - DNA, 25 bp, Rattus norvegicus
ttggcctcaaatacgtcaccttcag

SEQ ID NO: 681646 - DNA, 25 bp, Rattus norvegicus
ttggcctcaaattcgtcaccttcag

SEQ ID NO: 681647 - DNA, 25 bp, Rattus norvegicus
ttggcctcagatccttgcctgtagg

SEQ ID NO: 681648 - DNA, 25 bp, Rattus norvegicus
ttggcctcagatgcttgcctgtagg

SEQ ID NO: 681649 - DNA, 25 bp, Rattus norvegicus
ttggcctcagctagttggtccgtca

SEQ ID NO: 681650 - DNA, 25 bp, Rattus norvegicus
ttggcctcagcttgttggtccgtca

SEQ ID NO: 681651 - DNA, 25 bp, Rattus norvegicus
ttggcctcattactctgtgttcaca

SEQ ID NO: 681652 - DNA, 25 bp, Rattus norvegicus
ttggcctcattagtctgtgttcaca

SEQ ID NO: 681653 - DNA, 25 bp, Rattus norvegicus
ttggcctcatttaggtatacctgca

SEQ ID NO: 681654 - DNA, 25 bp, Rattus norvegicus
ttggcctcattttggtatacctgca

SEQ ID NO: 681655 - DNA, 25 bp, Rattus norvegicus
ttggcctccactcctgtgtaaatca

SEQ ID NO: 681656 - DNA, 25 bp, Rattus norvegicus
ttggcctccactgctgtgtaaatca

SEQ ID NO: 681657 - DNA, 25 bp, Rattus norvegicus
ttggcctcccaaaatatgtgattta

SEQ ID NO: 681658 - DNA, 25 bp, Rattus norvegicus
ttggcctcccaatatatgtgattta

SEQ ID NO: 681659 - DNA, 25 bp, Rattus norvegicus
ttggcctcctatatctatctgagac

SEQ ID NO: 681660 - DNA, 25 bp, Rattus norvegicus
ttggcctcctatttctatctgagac

SEQ ID NO: 681661 - DNA, 25 bp, Rattus norvegicus
ttggcctcctccaacaaagtgagag

SEQ ID NO: 681662 - DNA, 25 bp, Rattus norvegicus
ttggcctcctcctacaaagtgagag

SEQ ID NO: 681663 - DNA, 25 bp, Rattus norvegicus
ttggcctcctgcatgttaagctgaa

SEQ ID NO: 681664 - DNA, 25 bp, Rattus norvegicus
ttggcctcctgcttgttaagctgaa

SEQ ID NO: 681665 - DNA, 25 bp, Rattus norvegicus
ttggcctccttcaatgtaggtgcct

SEQ ID NO: 681666 - DNA, 25 bp, Rattus norvegicus
ttggcctccttctatgtaggtgcct

SEQ ID NO: 681667 - DNA, 25 bp, Rattus norvegicus
ttggcctcgtacatcagaaactgtc

SEQ ID NO: 681668 - DNA, 25 bp, Rattus norvegicus
ttggcctcgtacttcagaaactgtc

SEQ ID NO: 681669 - DNA, 25 bp, Rattus norvegicus
ttggcctctaataaacctcttgaag

SEQ ID NO: 681670 - DNA, 25 bp, Rattus norvegicus
ttggcctctaattaacctcttgaag

SEQ ID NO: 681671 - DNA, 25 bp, Rattus norvegicus
ttggcctctctgactccagaagcat

SEQ ID NO: 681672 - DNA, 25 bp, Rattus norvegicus
ttggcctctctgtctccagaagcat

SEQ ID NO: 681673 - DNA, 25 bp, Rattus norvegicus
ttggcctcttttctatcactcctga

SEQ ID NO: 681674 - DNA, 25 bp, Rattus norvegicus
ttggcctcttttgtatcactcctga

SEQ ID NO: 681675 - DNA, 25 bp, Rattus norvegicus
ttggcctgaagtcaaggacccctat

SEQ ID NO: 681676 - DNA, 25 bp, Rattus norvegicus
ttggcctgaagtgaaggacccctat

SEQ ID NO: 681677 - DNA, 25 bp, Rattus norvegicus
ttggcctgattcagtgtgaatgcac

SEQ ID NO: 681678 - DNA, 25 bp, Rattus norvegicus
ttggcctgattctgtgtgaatgcac

SEQ ID NO: 681679 - DNA, 25 bp, Rattus norvegicus
ttggcctgcgctatctggataaaaa

SEQ ID NO: 681680 - DNA, 25 bp, Rattus norvegicus
ttggcctgcgctttctggataaaaa

SEQ ID NO: 681681 - DNA, 25 bp, Rattus norvegicus
ttggcctgctggagaatccagctat

SEQ ID NO: 681682 - DNA, 25 bp, Rattus norvegicus
ttggcctgctggtgaatccagctat

SEQ ID NO: 681683 - DNA, 25 bp, Rattus norvegicus
ttggcctggaatacctatatgcttg

SEQ ID NO: 681684 - DNA, 25 bp, Rattus norvegicus
ttggcctggaattcctatatgcttg

SEQ ID NO: 681685 - DNA, 25 bp, Rattus norvegicus
ttggcctggatcattggcaggtgaa

SEQ ID NO: 681686 - DNA, 25 bp, Rattus norvegicus
ttggcctggatctttggcaggtgaa

SEQ ID NO: 681687 - DNA, 25 bp, Rattus norvegicus
ttggcctggtccacactagcctaaa

SEQ ID NO: 681688 - DNA, 25 bp, Rattus norvegicus
ttggcctggtcctcactagcctaaa

SEQ ID NO: 681689 - DNA, 25 bp, Rattus norvegicus
ttggcctggtctccaaagggagttc

SEQ ID NO: 681690 - DNA, 25 bp, Rattus norvegicus
ttggcctggtctgcaaagggagttc

SEQ ID NO: 681691 - DNA, 25 bp, Rattus norvegicus
ttggcctgtgtgcattgtcttgatt

SEQ ID NO: 681692 - DNA, 25 bp, Rattus norvegicus
ttggcctgtgtggattgtcttgatt

SEQ ID NO: 681693 - DNA, 25 bp, Rattus norvegicus
ttggccttcaatctcaggttggcaa

SEQ ID NO: 681694 - DNA, 25 bp, Rattus norvegicus
ttggccttcaatgtcaggttggcaa

SEQ ID NO: 681695 - DNA, 25 bp, Rattus norvegicus
ttggccttcaccagcaagctcaaga

SEQ ID NO: 681696 - DNA, 25 bp, Rattus norvegicus
ttggccttcacctgcaagctcaaga

SEQ ID NO: 681697 - DNA, 25 bp, Rattus norvegicus
ttggccttcagacttgctcagaaaa

SEQ ID NO: 681698 - DNA, 25 bp, Rattus norvegicus
ttggccttcagagttgctcagaaaa

SEQ ID NO: 681699 - DNA, 25 bp, Rattus norvegicus
ttggccttccacacgtatttaaatg

SEQ ID NO: 681700 - DNA, 25 bp, Rattus norvegicus
ttggccttccactcgtatttaaatg

SEQ ID NO: 681701 - DNA, 25 bp, Rattus norvegicus
ttggccttccctcgaagtcttgaag

SEQ ID NO: 681702 - DNA, 25 bp, Rattus norvegicus
ttggccttccctggaagtcttgaag

SEQ ID NO: 681703 - DNA, 25 bp, Rattus norvegicus
ttggccttcctcaatagttgcttga

SEQ ID NO: 681704 - DNA, 25 bp, Rattus norvegicus
ttggccttcctctatagttgcttga

SEQ ID NO: 681705 - DNA, 25 bp, Rattus norvegicus
ttggccttcgacaatggatcagact

SEQ ID NO: 681706 - DNA, 25 bp, Rattus norvegicus
ttggccttcgactatggatcagact

SEQ ID NO: 681707 - DNA, 25 bp, Rattus norvegicus
ttggccttctcaagcagttctgtga

SEQ ID NO: 681708 - DNA, 25 bp, Rattus norvegicus
ttggccttctcatgcagttctgtga

SEQ ID NO: 681709 - DNA, 25 bp, Rattus norvegicus
ttggccttgaggctcgagctgccca

SEQ ID NO: 681710 - DNA, 25 bp, Rattus norvegicus
ttggccttgagggtcgagctgccca

SEQ ID NO: 681711 - DNA, 25 bp, Rattus norvegicus
ttggccttgcacacagttcgagaga

SEQ ID NO: 681712 - DNA, 25 bp, Rattus norvegicus
ttggccttgcactcagttcgagaga

SEQ ID NO: 681713 - DNA, 25 bp, Rattus norvegicus
ttggccttggccatgaactgaggca

SEQ ID NO: 681714 - DNA, 25 bp, Rattus norvegicus
ttggccttggccttgaactgaggca

SEQ ID NO: 681715 - DNA, 25 bp, Rattus norvegicus
ttggccttggtgatggaattgcttt

SEQ ID NO: 681716 - DNA, 25 bp, Rattus norvegicus
ttggccttggtgttggaattgcttt

SEQ ID NO: 681717 - DNA, 25 bp, Rattus norvegicus
ttggcctttaacagaagcaccttcc

SEQ ID NO: 681718 - DNA, 25 bp, Rattus norvegicus
ttggcctttaactgaagcaccttcc

SEQ ID NO: 681719 - DNA, 25 bp, Rattus norvegicus
ttggcctttattaatcgctcgacac

SEQ ID NO: 681720 - DNA, 25 bp, Rattus norvegicus
ttggcctttatttatcgctcgacac

SEQ ID NO: 681721 - DNA, 25 bp, Rattus norvegicus
ttggcctttcggctcctagcgagct

SEQ ID NO: 681722 - DNA, 25 bp, Rattus norvegicus
ttggcctttcgggtcctagcgagct

SEQ ID NO: 681723 - DNA, 25 bp, Rattus norvegicus
ttggcctttggaataatttgggaca

SEQ ID NO: 681724 - DNA, 25 bp, Rattus norvegicus
ttggcctttggattaatttgggaca

SEQ ID NO: 681725 - DNA, 25 bp, Rattus norvegicus
ttggccttttcaaccattataagag

SEQ ID NO: 681726 - DNA, 25 bp, Rattus norvegicus
ttggccttttcatccattataagag

SEQ ID NO: 681727 - DNA, 25 bp, Rattus norvegicus
ttggcgaaatcaacgttgctcctca

SEQ ID NO: 681728 - DNA, 25 bp, Rattus norvegicus
ttggcgaaatcatcgttgctcctca

SEQ ID NO: 681729 - DNA, 25 bp, Rattus norvegicus
ttggcgaagtcgagtggtccctgat

SEQ ID NO: 681730 - DNA, 25 bp, Rattus norvegicus
ttggcgaagtcgtgtggtccctgat

SEQ ID NO: 681731 - DNA, 25 bp, Rattus norvegicus
ttggcgaatgtgcaagcttactgtc

SEQ ID NO: 681732 - DNA, 25 bp, Rattus norvegicus
ttggcgaatgtggaagcttactgtc

SEQ ID NO: 681733 - DNA, 25 bp, Rattus norvegicus
ttggcgacgccgagtgactccggct

SEQ ID NO: 681734 - DNA, 25 bp, Rattus norvegicus
ttggcgacgccgtgtgactccggct

SEQ ID NO: 681735 - DNA, 25 bp, Rattus norvegicus
ttggcgagcgtgattttcctttctt

SEQ ID NO: 681736 - DNA, 25 bp, Rattus norvegicus
ttggcgagcgtgtttttcctttctt

SEQ ID NO: 681737 - DNA, 25 bp, Rattus norvegicus
ttggcgagggaaaggcgtccgcgct

SEQ ID NO: 681738 - DNA, 25 bp, Rattus norvegicus
ttggcgagggaatggcgtccgcgct

SEQ ID NO: 681739 - DNA, 25 bp, Rattus norvegicus
ttggcgcagtcgcagacaacactta

SEQ ID NO: 681740 - DNA, 25 bp, Rattus norvegicus
ttggcgcagtcggagacaacactta

SEQ ID NO: 681741 - DNA, 25 bp, Rattus norvegicus
ttggcgcattagcagccgcgaagac

SEQ ID NO: 681742 - DNA, 25 bp, Rattus norvegicus
ttggcgcattaggagccgcgaagac

SEQ ID NO: 681743 - DNA, 25 bp, Rattus norvegicus
ttggcgcattgaagtccctgaaaat

SEQ ID NO: 681744 - DNA, 25 bp, Rattus norvegicus
ttggcgcattgatgtccctgaaaat

SEQ ID NO: 681745 - DNA, 25 bp, Rattus norvegicus
ttggcgcattggactctaggagtaa

SEQ ID NO: 681746 - DNA, 25 bp, Rattus norvegicus
ttggcgcattggtctctaggagtaa

SEQ ID NO: 681747 - DNA, 25 bp, Rattus norvegicus
ttggcgccgtgcaaacgtctttaat

SEQ ID NO: 681748 - DNA, 25 bp, Rattus norvegicus
ttggcgccgtgctaacgtctttaat

SEQ ID NO: 681749 - DNA, 25 bp, Rattus norvegicus
ttggcgccttttactgtcttctaaa

SEQ ID NO: 681750 - DNA, 25 bp, Rattus norvegicus
ttggcgcctttttctgtcttctaaa

SEQ ID NO: 681751 - DNA, 25 bp, Rattus norvegicus
ttggcgcgagagacacttcagcagc

SEQ ID NO: 681752 - DNA, 25 bp, Rattus norvegicus
ttggcgcgagagtcacttcagcagc

SEQ ID NO: 681753 - DNA, 25 bp, Rattus norvegicus
ttggcgctaacaaggatgctagatc

SEQ ID NO: 681754 - DNA, 25 bp, Rattus norvegicus
ttggcgctaacatggatgctagatc

SEQ ID NO: 681755 - DNA, 25 bp, Rattus norvegicus
ttggcggaccccatgaaggtacgtg

SEQ ID NO: 681756 - DNA, 25 bp, Rattus norvegicus
ttggcggaccccttgaaggtacgtg

SEQ ID NO: 681757 - DNA, 25 bp, Rattus norvegicus
ttggcggcaaagcttgcattccaga

SEQ ID NO: 681758 - DNA, 25 bp, Rattus norvegicus
ttggcggcaaaggttgcattccaga

SEQ ID NO: 681759 - DNA, 25 bp, Rattus norvegicus
ttggcggcgccaacagaaaggcatc

SEQ ID NO: 681760 - DNA, 25 bp, Rattus norvegicus
ttggcggcgccatcagaaaggcatc

SEQ ID NO: 681761 - DNA, 25 bp, Rattus norvegicus
ttggcggctactcccaggcctacgg

SEQ ID NO: 681762 - DNA, 25 bp, Rattus norvegicus
ttggcggctactgccaggcctacgg

SEQ ID NO: 681763 - DNA, 25 bp, Rattus norvegicus
ttggcggctgcaatacattctgacc

SEQ ID NO: 681764 - DNA, 25 bp, Rattus norvegicus
ttggcggctgcattacattctgacc

SEQ ID NO: 681765 - DNA, 25 bp, Rattus norvegicus
ttggcggtaccgagcaatgaaattg

SEQ ID NO: 681766 - DNA, 25 bp, Rattus norvegicus
ttggcggtaccgtgcaatgaaattg

SEQ ID NO: 681767 - DNA, 25 bp, Rattus norvegicus
ttggcggtagctaatctgactagta

SEQ ID NO: 681768 - DNA, 25 bp, Rattus norvegicus
ttggcggtagcttatctgactagta

SEQ ID NO: 681769 - DNA, 25 bp, Rattus norvegicus
ttggcggtcaaaacttataattcac

SEQ ID NO: 681770 - DNA, 25 bp, Rattus norvegicus
ttggcggtcaaatcttataattcac

SEQ ID NO: 681771 - DNA, 25 bp, Rattus norvegicus
ttggcggtccggaacatcagcagag

SEQ ID NO: 681772 - DNA, 25 bp, Rattus norvegicus
ttggcggtccggtacatcagcagag

SEQ ID NO: 681773 - DNA, 25 bp, Rattus norvegicus
ttggcggtgcagctcctcaacacag

SEQ ID NO: 681774 - DNA, 25 bp, Rattus norvegicus
ttggcggtgcaggtcctcaacacag

SEQ ID NO: 681775 - DNA, 25 bp, Rattus norvegicus
ttggcggtgctgacagcgcacagac

SEQ ID NO: 681776 - DNA, 25 bp, Rattus norvegicus
ttggcggtgctgtcagcgcacagac

SEQ ID NO: 681777 - DNA, 25 bp, Rattus norvegicus
ttggcggtgtagactgcagctccta

SEQ ID NO: 681778 - DNA, 25 bp, Rattus norvegicus
ttggcggtgtagtctgcagctccta

SEQ ID NO: 681779 - DNA, 25 bp, Rattus norvegicus
ttggcgtaacgcaatttttctgtat

SEQ ID NO: 681780 - DNA, 25 bp, Rattus norvegicus
ttggcgtaacgctatttttctgtat

SEQ ID NO: 681781 - DNA, 25 bp, Rattus norvegicus
ttggcgtaccgcaggatcacgtaaa

SEQ ID NO: 681782 - DNA, 25 bp, Rattus norvegicus
ttggcgtaccgctggatcacgtaaa

SEQ ID NO: 681783 - DNA, 25 bp, Rattus norvegicus
ttggcgtatactcaccagcctcgaa

SEQ ID NO: 681784 - DNA, 25 bp, Rattus norvegicus
ttggcgtatactgaccagcctcgaa

SEQ ID NO: 681785 - DNA, 25 bp, Rattus norvegicus
ttggcgtcacccaggtctattacct

SEQ ID NO: 681786 - DNA, 25 bp, Rattus norvegicus
ttggcgtcaccctggtctattacct

SEQ ID NO: 681787 - DNA, 25 bp, Rattus norvegicus
ttggcgtcggcgactgcctcggttc

SEQ ID NO: 681788 - DNA, 25 bp, Rattus norvegicus
ttggcgtcggcgtctgcctcggttc

SEQ ID NO: 681789 - DNA, 25 bp, Rattus norvegicus
ttggcgtcttctcagacacagctcc

SEQ ID NO: 681790 - DNA, 25 bp, Rattus norvegicus
ttggcgtcttctgagacacagctcc

SEQ ID NO: 681791 - DNA, 25 bp, Rattus norvegicus
ttggcgtcttgactgtaccctgggt

SEQ ID NO: 681792 - DNA, 25 bp, Rattus norvegicus
ttggcgtcttgagtgtaccctgggt

SEQ ID NO: 681793 - DNA, 25 bp, Rattus norvegicus
ttggcgtcttgcaggaacaggctta

SEQ ID NO: 681794 - DNA, 25 bp, Rattus norvegicus
ttggcgtcttgctggaacaggctta

SEQ ID NO: 681795 - DNA, 25 bp, Rattus norvegicus
ttggcgtctttgaacactcagtgtc

SEQ ID NO: 681796 - DNA, 25 bp, Rattus norvegicus
ttggcgtctttgtacactcagtgtc

SEQ ID NO: 681797 - DNA, 25 bp, Rattus norvegicus
ttggcgtgtctactgtggttcctca

SEQ ID NO: 681798 - DNA, 25 bp, Rattus norvegicus
ttggcgtgtctagtgtggttcctca

SEQ ID NO: 681799 - DNA, 25 bp, Rattus norvegicus
ttggcgttacctccattcacataca

SEQ ID NO: 681800 - DNA, 25 bp, Rattus norvegicus
ttggcgttacctgcattcacataca

SEQ ID NO: 681801 - DNA, 25 bp, Rattus norvegicus
ttggcgttcagaaccaatccctgta

SEQ ID NO: 681802 - DNA, 25 bp, Rattus norvegicus
ttggcgttcagatccaatccctgta

SEQ ID NO: 681803 - DNA, 25 bp, Rattus norvegicus
ttggcgttcttgaatgtgcgttcag

SEQ ID NO: 681804 - DNA, 25 bp, Rattus norvegicus
ttggcgttcttgtatgtgcgttcag

SEQ ID NO: 681805 - DNA, 25 bp, Rattus norvegicus
ttggcgttgactactgccagactag

SEQ ID NO: 681806 - DNA, 25 bp, Rattus norvegicus
ttggcgttgacttctgccagactag

SEQ ID NO: 681807 - DNA, 25 bp, Rattus norvegicus
ttggctaaacccacatggagatcct

SEQ ID NO: 681808 - DNA, 25 bp, Rattus norvegicus
ttggctaaaccctcatggagatcct

SEQ ID NO: 681809 - DNA, 25 bp, Rattus norvegicus
ttggctaaacctcccagtgtcctaa

SEQ ID NO: 681810 - DNA, 25 bp, Rattus norvegicus
ttggctaaacctgccagtgtcctaa

SEQ ID NO: 681811 - DNA, 25 bp, Rattus norvegicus
ttggctaaactgatgttggcaatct

SEQ ID NO: 681812 - DNA, 25 bp, Rattus norvegicus
ttggctaaactgttgttggcaatct

SEQ ID NO: 681813 - DNA, 25 bp, Rattus norvegicus
ttggctaaccatcttcttctttctt

SEQ ID NO: 681814 - DNA, 25 bp, Rattus norvegicus
ttggctaaccatgttcttctttctt

SEQ ID NO: 681815 - DNA, 25 bp, Rattus norvegicus
ttggctaacgtaacgcatcagtgca

SEQ ID NO: 681816 - DNA, 25 bp, Rattus norvegicus
ttggctaacgtatcgcatcagtgca

SEQ ID NO: 681817 - DNA, 25 bp, Rattus norvegicus
ttggctaactccctacaggatagac

SEQ ID NO: 681818 - DNA, 25 bp, Rattus norvegicus
ttggctaactccgtacaggatagac

SEQ ID NO: 681819 - DNA, 25 bp, Rattus norvegicus
ttggctaactgcagggagggaactt

SEQ ID NO: 681820 - DNA, 25 bp, Rattus norvegicus
ttggctaactgctgggagggaactt

SEQ ID NO: 681821 - DNA, 25 bp, Rattus norvegicus
ttggctaagcggcagggaaatacat

SEQ ID NO: 681822 - DNA, 25 bp, Rattus norvegicus
ttggctaagcgggagggaaatacat

SEQ ID NO: 681823 - DNA, 25 bp, Rattus norvegicus
ttggctaatgacacagaagagatgt

SEQ ID NO: 681824 - DNA, 25 bp, Rattus norvegicus
ttggctaatgactcagaagagatgt

SEQ ID NO: 681825 - DNA, 25 bp, Rattus norvegicus
ttggctaccactcagcatggaggct

SEQ ID NO: 681826 - DNA, 25 bp, Rattus norvegicus
ttggctaccactgagcatggaggct

SEQ ID NO: 681827 - DNA, 25 bp, Rattus norvegicus
ttggctaccatccaggtccaaagtg

SEQ ID NO: 681828 - DNA, 25 bp, Rattus norvegicus
ttggctaccatcgaggtccaaagtg

SEQ ID NO: 681829 - DNA, 25 bp, Rattus norvegicus
ttggctaccccaagactctatgtgt

SEQ ID NO: 681830 - DNA, 25 bp, Rattus norvegicus
ttggctaccccatgactctatgtgt

SEQ ID NO: 681831 - DNA, 25 bp, Rattus norvegicus
ttggctacgggactgacctgcggaa

SEQ ID NO: 681832 - DNA, 25 bp, Rattus norvegicus
ttggctacgggagtgacctgcggaa

SEQ ID NO: 681833 - DNA, 25 bp, Rattus norvegicus
ttggctactcttaactgactggtta

SEQ ID NO: 681834 - DNA, 25 bp, Rattus norvegicus
ttggctactctttactgactggtta

SEQ ID NO: 681835 - DNA, 25 bp, Rattus norvegicus
ttggctagagagaggcccatttgat

SEQ ID NO: 681836 - DNA, 25 bp, Rattus norvegicus
ttggctagagagtggcccatttgat

SEQ ID NO: 681837 - DNA, 25 bp, Rattus norvegicus
ttggctagagtcatcttaagtattc

SEQ ID NO: 681838 - DNA, 25 bp, Rattus norvegicus
ttggctagagtcttcttaagtattc

SEQ ID NO: 681839 - DNA, 25 bp, Rattus norvegicus
ttggctagcaagacagctcagtggg

SEQ ID NO: 681840 - DNA, 25 bp, Rattus norvegicus
ttggctagcaagtcagctcagtggg

SEQ ID NO: 681841 - DNA, 25 bp, Rattus norvegicus
ttggctagctacacggaggaacctg

SEQ ID NO: 681842 - DNA, 25 bp, Rattus norvegicus
ttggctagctactcggaggaacctg

SEQ ID NO: 681843 - DNA, 25 bp, Rattus norvegicus
ttggctaggagacgcggcgccacga

SEQ ID NO: 681844 - DNA, 25 bp, Rattus norvegicus
ttggctaggagaggcggcgccacga

SEQ ID NO: 681845 - DNA, 25 bp, Rattus norvegicus
ttggctagttagaggcctctccttg

SEQ ID NO: 681846 - DNA, 25 bp, Rattus norvegicus
ttggctagttagtggcctctccttg

SEQ ID NO: 681847 - DNA, 25 bp, Rattus norvegicus
ttggctatgcgtcgcggaccaataa

SEQ ID NO: 681848 - DNA, 25 bp, Rattus norvegicus
ttggctatgcgtggcggaccaataa

SEQ ID NO: 681849 - DNA, 25 bp, Rattus norvegicus
ttggctattcatccagcatcttaat

SEQ ID NO: 681850 - DNA, 25 bp, Rattus norvegicus
ttggctattcatgcagcatcttaat

SEQ ID NO: 681851 - DNA, 25 bp, Rattus norvegicus
ttggctcaaaaaacaaatttctgaa

SEQ ID NO: 681852 - DNA, 25 bp, Rattus norvegicus
ttggctcaaaaatcaaatttctgaa

SEQ ID NO: 681853 - DNA, 25 bp, Rattus norvegicus
ttggctcaacttatgcatctcatgc

SEQ ID NO: 681854 - DNA, 25 bp, Rattus norvegicus
ttggctcaacttttgcatctcatgc

SEQ ID NO: 681855 - DNA, 25 bp, Rattus norvegicus
ttggctcaagtgatcaatctcaccc

SEQ ID NO: 681856 - DNA, 25 bp, Rattus norvegicus
ttggctcaagtgattccccagctca

SEQ ID NO: 681857 - DNA, 25 bp, Rattus norvegicus
ttggctcaagtgttcaatctcaccc

SEQ ID NO: 681858 - DNA, 25 bp, Rattus norvegicus
ttggctcaagtgtttccccagctca

SEQ ID NO: 681859 - DNA, 25 bp, Rattus norvegicus
ttggctcagaggaggcatgaagcat

SEQ ID NO: 681860 - DNA, 25 bp, Rattus norvegicus
ttggctcagaggtggcatgaagcat

SEQ ID NO: 681861 - DNA, 25 bp, Rattus norvegicus
ttggctcagcctagttttcaaaatg

SEQ ID NO: 681862 - DNA, 25 bp, Rattus norvegicus
ttggctcagccttgttttcaaaatg

SEQ ID NO: 681863 - DNA, 25 bp, Rattus norvegicus
ttggctcagtcgcttgacttgaagc

SEQ ID NO: 681864 - DNA, 25 bp, Rattus norvegicus
ttggctcagtcggttgacttgaagc

SEQ ID NO: 681865 - DNA, 25 bp, Rattus norvegicus
ttggctcagttcatgaggctcctta

SEQ ID NO: 681866 - DNA, 25 bp, Rattus norvegicus
ttggctcagttcttgaggctcctta

SEQ ID NO: 681867 - DNA, 25 bp, Rattus norvegicus
ttggctcatgatagtctttgtcgca

SEQ ID NO: 681868 - DNA, 25 bp, Rattus norvegicus
ttggctcatgattgtctttgtcgca

SEQ ID NO: 681869 - DNA, 25 bp, Rattus norvegicus
ttggctcattttaatgctcctcagg

SEQ ID NO: 681870 - DNA, 25 bp, Rattus norvegicus
ttggctcatttttatgctcctcagg

SEQ ID NO: 681871 - DNA, 25 bp, Rattus norvegicus
ttggctccactcatgcaagcagtgg

SEQ ID NO: 681872 - DNA, 25 bp, Rattus norvegicus
ttggctccactcttgcaagcagtgg

SEQ ID NO: 681873 - DNA, 25 bp, Rattus norvegicus
ttggctccacttatccggaagctga

SEQ ID NO: 681874 - DNA, 25 bp, Rattus norvegicus
ttggctccacttatgtcctgcaaac

SEQ ID NO: 681875 - DNA, 25 bp, Rattus norvegicus
ttggctccacttttccggaagctga

SEQ ID NO: 681876 - DNA, 25 bp, Rattus norvegicus
ttggctccacttttgtcctgcaaac

SEQ ID NO: 681877 - DNA, 25 bp, Rattus norvegicus
ttggctccagtgatcagcacagctg

SEQ ID NO: 681878 - DNA, 25 bp, Rattus norvegicus
ttggctccagtgttcagcacagctg

SEQ ID NO: 681879 - DNA, 25 bp, Rattus norvegicus
ttggctcccaatccaactagagaca

SEQ ID NO: 681880 - DNA, 25 bp, Rattus norvegicus
ttggctcccaatgcaactagagaca

SEQ ID NO: 681881 - DNA, 25 bp, Rattus norvegicus
ttggctcccatgattaacgtctctc

SEQ ID NO: 681882 - DNA, 25 bp, Rattus norvegicus
ttggctcccatgcaagcctttggct

SEQ ID NO: 681883 - DNA, 25 bp, Rattus norvegicus
ttggctcccatggaagcctttggct

SEQ ID NO: 681884 - DNA, 25 bp, Rattus norvegicus
ttggctcccatgtttaacgtctctc

SEQ ID NO: 681885 - DNA, 25 bp, Rattus norvegicus
ttggctccctccaggaaaccatttt

SEQ ID NO: 681886 - DNA, 25 bp, Rattus norvegicus
ttggctccctcctggaaaccatttt

SEQ ID NO: 681887 - DNA, 25 bp, Rattus norvegicus
ttggctccgctcaattgttaccatt

SEQ ID NO: 681888 - DNA, 25 bp, Rattus norvegicus
ttggctccgctctattgttaccatt

SEQ ID NO: 681889 - DNA, 25 bp, Rattus norvegicus
ttggctccgggcatctttcattaaa

SEQ ID NO: 681890 - DNA, 25 bp, Rattus norvegicus
ttggctccgggcttctttcattaaa

SEQ ID NO: 681891 - DNA, 25 bp, Rattus norvegicus
ttggctccgtcgcagcacgaggaac

SEQ ID NO: 681892 - DNA, 25 bp, Rattus norvegicus
ttggctccgtcggagcacgaggaac

SEQ ID NO: 681893 - DNA, 25 bp, Rattus norvegicus
ttggctcctaagactcatgtttggt

SEQ ID NO: 681894 - DNA, 25 bp, Rattus norvegicus
ttggctcctaagtctcatgtttggt

SEQ ID NO: 681895 - DNA, 25 bp, Rattus norvegicus
ttggctcctagtatattttgtttgt

SEQ ID NO: 681896 - DNA, 25 bp, Rattus norvegicus
ttggctcctagtttattttgtttgt

SEQ ID NO: 681897 - DNA, 25 bp, Rattus norvegicus
ttggctcctatcacaaacgttcctt

SEQ ID NO: 681898 - DNA, 25 bp, Rattus norvegicus
ttggctcctatctcaaacgttcctt

SEQ ID NO: 681899 - DNA, 25 bp, Rattus norvegicus
ttggctcctggaatctctgaaagaa

SEQ ID NO: 681900 - DNA, 25 bp, Rattus norvegicus
ttggctcctggattctctgaaagaa

SEQ ID NO: 681901 - DNA, 25 bp, Rattus norvegicus
ttggctccttggataacatcaccca

SEQ ID NO: 681902 - DNA, 25 bp, Rattus norvegicus
ttggctccttggttaacatcaccca

SEQ ID NO: 681903 - DNA, 25 bp, Rattus norvegicus
ttggctcgcctaatgtgacatggca

SEQ ID NO: 681904 - DNA, 25 bp, Rattus norvegicus
ttggctcgcctattgtgacatggca

SEQ ID NO: 681905 - DNA, 25 bp, Rattus norvegicus
ttggctcgtaccctcagataataaa

SEQ ID NO: 681906 - DNA, 25 bp, Rattus norvegicus
ttggctcgtaccgtcagataataaa

SEQ ID NO: 681907 - DNA, 25 bp, Rattus norvegicus
ttggctctacacattgcttcgggaa

SEQ ID NO: 681908 - DNA, 25 bp, Rattus norvegicus
ttggctctacactttgcttcgggaa

SEQ ID NO: 681909 - DNA, 25 bp, Rattus norvegicus
ttggctctagctaaagtttccgaaa

SEQ ID NO: 681910 - DNA, 25 bp, Rattus norvegicus
ttggctctagcttaagtttccgaaa

SEQ ID NO: 681911 - DNA, 25 bp, Rattus norvegicus
ttggctctatcacttatttctcttg

SEQ ID NO: 681912 - DNA, 25 bp, Rattus norvegicus
ttggctctatcagttatttctcttg

SEQ ID NO: 681913 - DNA, 25 bp, Rattus norvegicus
ttggctctcctgacaatcagcaaag

SEQ ID NO: 681914 - DNA, 25 bp, Rattus norvegicus
ttggctctcctgtcaatcagcaaag

SEQ ID NO: 681915 - DNA, 25 bp, Rattus norvegicus
ttggctctcggcattgtagttgaga

SEQ ID NO: 681916 - DNA, 25 bp, Rattus norvegicus
ttggctctcggctttgtagttgaga

SEQ ID NO: 681917 - DNA, 25 bp, Rattus norvegicus
ttggctctctacctagggcctacag

SEQ ID NO: 681918 - DNA, 25 bp, Rattus norvegicus
ttggctctctacgtagggcctacag

SEQ ID NO: 681919 - DNA, 25 bp, Rattus norvegicus
ttggctctgaatacattgtgtggat

SEQ ID NO: 681920 - DNA, 25 bp, Rattus norvegicus
ttggctctgaatccccagtggaaat

SEQ ID NO: 681921 - DNA, 25 bp, Rattus norvegicus
ttggctctgaatcctgtaggccagc

SEQ ID NO: 681922 - DNA, 25 bp, Rattus norvegicus
ttggctctgaatccttggaatcaag

SEQ ID NO: 681923 - DNA, 25 bp, Rattus norvegicus
ttggctctgaatgcccagtggaaat

SEQ ID NO: 681924 - DNA, 25 bp, Rattus norvegicus
ttggctctgaatgctgtaggccagc

SEQ ID NO: 681925 - DNA, 25 bp, Rattus norvegicus
ttggctctgaatgcttggaatcaag

SEQ ID NO: 681926 - DNA, 25 bp, Rattus norvegicus
ttggctctgaattcattgtgtggat

SEQ ID NO: 681927 - DNA, 25 bp, Rattus norvegicus
ttggctctgagactcagtttcctca

SEQ ID NO: 681928 - DNA, 25 bp, Rattus norvegicus
ttggctctgagagtcagtttcctca

SEQ ID NO: 681929 - DNA, 25 bp, Rattus norvegicus
ttggctctgcctatggcattttaac

SEQ ID NO: 681930 - DNA, 25 bp, Rattus norvegicus
ttggctctgcctttggcattttaac

SEQ ID NO: 681931 - DNA, 25 bp, Rattus norvegicus
ttggctctgtgaccgagtctctgca

SEQ ID NO: 681932 - DNA, 25 bp, Rattus norvegicus
ttggctctgtgagcgagtctctgca

SEQ ID NO: 681933 - DNA, 25 bp, Rattus norvegicus
ttggctcttcaaaaagcagagtctg

SEQ ID NO: 681934 - DNA, 25 bp, Rattus norvegicus
ttggctcttcaataagcagagtctg

SEQ ID NO: 681935 - DNA, 25 bp, Rattus norvegicus
ttggctcttcatcccctgtgggaga

SEQ ID NO: 681936 - DNA, 25 bp, Rattus norvegicus
ttggctcttcatgccctgtgggaga

SEQ ID NO: 681937 - DNA, 25 bp, Rattus norvegicus
ttggctcttgccaggagacgcatga

SEQ ID NO: 681938 - DNA, 25 bp, Rattus norvegicus
ttggctcttgcctggagacgcatga

SEQ ID NO: 681939 - DNA, 25 bp, Rattus norvegicus
ttggctcttttgacctgaatcttac

SEQ ID NO: 681940 - DNA, 25 bp, Rattus norvegicus
ttggctcttttgtcctgaatcttac

SEQ ID NO: 681941 - DNA, 25 bp, Rattus norvegicus
ttggctgaacaacatatccctgaca

SEQ ID NO: 681942 - DNA, 25 bp, Rattus norvegicus
ttggctgaacaagatatccctgaca

SEQ ID NO: 681943 - DNA, 25 bp, Rattus norvegicus
ttggctgaacagctgggaaccttca

SEQ ID NO: 681944 - DNA, 25 bp, Rattus norvegicus
ttggctgaacaggtgggaaccttca

SEQ ID NO: 681945 - DNA, 25 bp, Rattus norvegicus
ttggctgaacttaacactcccttga

SEQ ID NO: 681946 - DNA, 25 bp, Rattus norvegicus
ttggctgaactttacactcccttga

SEQ ID NO: 681947 - DNA, 25 bp, Rattus norvegicus
ttggctgaatttcatactggaagac

SEQ ID NO: 681948 - DNA, 25 bp, Rattus norvegicus
ttggctgaatttgatactggaagac

SEQ ID NO: 681949 - DNA, 25 bp, Rattus norvegicus
ttggctgacaccagcgattcctgct

SEQ ID NO: 681950 - DNA, 25 bp, Rattus norvegicus
ttggctgacacctgcgattcctgct

SEQ ID NO: 681951 - DNA, 25 bp, Rattus norvegicus
ttggctgacactcctttgaggtgtg

SEQ ID NO: 681952 - DNA, 25 bp, Rattus norvegicus
ttggctgacactgctttgaggtgtg

SEQ ID NO: 681953 - DNA, 25 bp, Rattus norvegicus
ttggctgacccacgtggtgacctaa

SEQ ID NO: 681954 - DNA, 25 bp, Rattus norvegicus
ttggctgacccaggtggtgacctaa

SEQ ID NO: 681955 - DNA, 25 bp, Rattus norvegicus
ttggctgactcactcaaactgacga

SEQ ID NO: 681956 - DNA, 25 bp, Rattus norvegicus
ttggctgactcagtcaaactgacga

SEQ ID NO: 681957 - DNA, 25 bp, Rattus norvegicus
ttggctgactggatccacagcagtg

SEQ ID NO: 681958 - DNA, 25 bp, Rattus norvegicus
ttggctgactggttccacagcagtg

SEQ ID NO: 681959 - DNA, 25 bp, Rattus norvegicus
ttggctgagatgctaccgtctgtca

SEQ ID NO: 681960 - DNA, 25 bp, Rattus norvegicus
ttggctgagatggtaccgtctgtca

SEQ ID NO: 681961 - DNA, 25 bp, Rattus norvegicus
ttggctgatacccagtcccttcagt

SEQ ID NO: 681962 - DNA, 25 bp, Rattus norvegicus
ttggctgataccgagtcccttcagt

SEQ ID NO: 681963 - DNA, 25 bp, Rattus norvegicus
ttggctgcaagtcactttacgcact

SEQ ID NO: 681964 - DNA, 25 bp, Rattus norvegicus
ttggctgcaagtgactttacgcact

SEQ ID NO: 681965 - DNA, 25 bp, Rattus norvegicus
ttggctgcaatcaactgctaagcgg

SEQ ID NO: 681966 - DNA, 25 bp, Rattus norvegicus
ttggctgcaatctactgctaagcgg

SEQ ID NO: 681967 - DNA, 25 bp, Rattus norvegicus
ttggctgcacagaagtcaccttaga

SEQ ID NO: 681968 - DNA, 25 bp, Rattus norvegicus
ttggctgcacagtagtcaccttaga

SEQ ID NO: 681969 - DNA, 25 bp, Rattus norvegicus
ttggctgcaggcacacctttaagat

SEQ ID NO: 681970 - DNA, 25 bp, Rattus norvegicus
ttggctgcaggctcacctttaagat

SEQ ID NO: 681971 - DNA, 25 bp, Rattus norvegicus
ttggctgcatcaaagtccagtgtcc

SEQ ID NO: 681972 - DNA, 25 bp, Rattus norvegicus
ttggctgcatcatagtccagtgtcc

SEQ ID NO: 681973 - DNA, 25 bp, Rattus norvegicus
ttggctgccagacctcatcttgaga

SEQ ID NO: 681974 - DNA, 25 bp, Rattus norvegicus
ttggctgccagagctcatcttgaga

SEQ ID NO: 681975 - DNA, 25 bp, Rattus norvegicus
ttggctgccagccatgactacagag

SEQ ID NO: 681976 - DNA, 25 bp, Rattus norvegicus
ttggctgccagcgatgactacagag

SEQ ID NO: 681977 - DNA, 25 bp, Rattus norvegicus
ttggctgccatcatcctggtaagat

SEQ ID NO: 681978 - DNA, 25 bp, Rattus norvegicus
ttggctgccatcatttgaagtctct

SEQ ID NO: 681979 - DNA, 25 bp, Rattus norvegicus
ttggctgccatcttcctggtaagat

SEQ ID NO: 681980 - DNA, 25 bp, Rattus norvegicus
ttggctgccatcttttgaagtctct

SEQ ID NO: 681981 - DNA, 25 bp, Rattus norvegicus
ttggctgcccttcattacgaatgtt

SEQ ID NO: 681982 - DNA, 25 bp, Rattus norvegicus
ttggctgcccttgattacgaatgtt

SEQ ID NO: 681983 - DNA, 25 bp, Rattus norvegicus
ttggctgccttcatatgcttttaaa

SEQ ID NO: 681984 - DNA, 25 bp, Rattus norvegicus
ttggctgccttcttatgcttttaaa

SEQ ID NO: 681985 - DNA, 25 bp, Rattus norvegicus
ttggctgcggatacccgcctagaca

SEQ ID NO: 681986 - DNA, 25 bp, Rattus norvegicus
ttggctgcggattcccgcctagaca

SEQ ID NO: 681987 - DNA, 25 bp, Rattus norvegicus
ttggctgctctcaaggcaattctaa

SEQ ID NO: 681988 - DNA, 25 bp, Rattus norvegicus
ttggctgctctctaggcaattctaa

SEQ ID NO: 681989 - DNA, 25 bp, Rattus norvegicus
ttggctgctctgcacatcatcggaa

SEQ ID NO: 681990 - DNA, 25 bp, Rattus norvegicus
ttggctgctctggacatcatcggaa

SEQ ID NO: 681991 - DNA, 25 bp, Rattus norvegicus
ttggctgcttgaacttagttgtaaa

SEQ ID NO: 681992 - DNA, 25 bp, Rattus norvegicus
ttggctgcttgatcttagttgtaaa

SEQ ID NO: 681993 - DNA, 25 bp, Rattus norvegicus
ttggctggaccaatctcactaaggg

SEQ ID NO: 681994 - DNA, 25 bp, Rattus norvegicus
ttggctggaccattctcactaaggg

SEQ ID NO: 681995 - DNA, 25 bp, Rattus norvegicus
ttggctggatcccatgttttgccca

SEQ ID NO: 681996 - DNA, 25 bp, Rattus norvegicus
ttggctggatccgatgttttgccca

SEQ ID NO: 681997 - DNA, 25 bp, Rattus norvegicus
ttggctggcccacctagaaccatag

SEQ ID NO: 681998 - DNA, 25 bp, Rattus norvegicus
ttggctggcccacgaagcaggaact

SEQ ID NO: 681999 - DNA, 25 bp, Rattus norvegicus
ttggctggcccagctagaaccatag

SEQ ID NO: 682000 - DNA, 25 bp, Rattus norvegicus
ttggctggcccaggaagcaggaact

SEQ ID NO: 682001 - DNA, 25 bp, Rattus norvegicus
ttggctggcctgaatttcactgtat

SEQ ID NO: 682002 - DNA, 25 bp, Rattus norvegicus
ttggctggcctgtatttcactgtat

SEQ ID NO: 682003 - DNA, 25 bp, Rattus norvegicus
ttggctggccttactcagtggatct

SEQ ID NO: 682004 - DNA, 25 bp, Rattus norvegicus
ttggctggcctttctcagtggatct

SEQ ID NO: 682005 - DNA, 25 bp, Rattus norvegicus
ttggctggcttgagccttgaactca

SEQ ID NO: 682006 - DNA, 25 bp, Rattus norvegicus
ttggctggcttgtgccttgaactca

SEQ ID NO: 682007 - DNA, 25 bp, Rattus norvegicus
ttggctgggtccatgatcttcaaga

SEQ ID NO: 682008 - DNA, 25 bp, Rattus norvegicus
ttggctgggtccttgatcttcaaga

SEQ ID NO: 682009 - DNA, 25 bp, Rattus norvegicus
ttggctggtcaacttgaacattgtt

SEQ ID NO: 682010 - DNA, 25 bp, Rattus norvegicus
ttggctggtcaagttgaacattgtt

SEQ ID NO: 682011 - DNA, 25 bp, Rattus norvegicus
ttggctggtcatatcctgtaggtat

SEQ ID NO: 682012 - DNA, 25 bp, Rattus norvegicus
ttggctggtcatttcctgtaggtat

SEQ ID NO: 682013 - DNA, 25 bp, Rattus norvegicus
ttggctgtaggtctgcactgtctat

SEQ ID NO: 682014 - DNA, 25 bp, Rattus norvegicus
ttggctgtaggtgtgcactgtctat

SEQ ID NO: 682015 - DNA, 25 bp, Rattus norvegicus
ttggctgtagttagtctcccaacag

SEQ ID NO: 682016 - DNA, 25 bp, Rattus norvegicus
ttggctgtagtttgtctcccaacag

SEQ ID NO: 682017 - DNA, 25 bp, Rattus norvegicus
ttggctgtcaacattagtgtttcta

SEQ ID NO: 682018 - DNA, 25 bp, Rattus norvegicus
ttggctgtcaactttagtgtttcta

SEQ ID NO: 682019 - DNA, 25 bp, Rattus norvegicus
ttggctgtccagactctggagtatt

SEQ ID NO: 682020 - DNA, 25 bp, Rattus norvegicus
ttggctgtccagtctctggagtatt

SEQ ID NO: 682021 - DNA, 25 bp, Rattus norvegicus
ttggctgtcctaattatgcccagta

SEQ ID NO: 682022 - DNA, 25 bp, Rattus norvegicus
ttggctgtcctatttatgcccagta

SEQ ID NO: 682023 - DNA, 25 bp, Rattus norvegicus
ttggctgtcctgacatgactgctgg

SEQ ID NO: 682024 - DNA, 25 bp, Rattus norvegicus
ttggctgtcctgtcatgactgctgg

SEQ ID NO: 682025 - DNA, 25 bp, Rattus norvegicus
ttggctgtccttagtggcgttggca

SEQ ID NO: 682026 - DNA, 25 bp, Rattus norvegicus
ttggctgtcctttgtggcgttggca

SEQ ID NO: 682027 - DNA, 25 bp, Rattus norvegicus
ttggctgtctctagactgtggtaag

SEQ ID NO: 682028 - DNA, 25 bp, Rattus norvegicus
ttggctgtctcttgactgtggtaag

SEQ ID NO: 682029 - DNA, 25 bp, Rattus norvegicus
ttggctgtctggagcgcgctcacag

SEQ ID NO: 682030 - DNA, 25 bp, Rattus norvegicus
ttggctgtctggtgcgcgctcacag

SEQ ID NO: 682031 - DNA, 25 bp, Rattus norvegicus
ttggctgtcttcacctgtgctgaga

SEQ ID NO: 682032 - DNA, 25 bp, Rattus norvegicus
ttggctgtcttctcctgtgctgaga

SEQ ID NO: 682033 - DNA, 25 bp, Rattus norvegicus
ttggctgtcttgaggctctccacat

SEQ ID NO: 682034 - DNA, 25 bp, Rattus norvegicus
ttggctgtcttgtggctctccacat

SEQ ID NO: 682035 - DNA, 25 bp, Rattus norvegicus
ttggctgtgagcatccacctgtgta

SEQ ID NO: 682036 - DNA, 25 bp, Rattus norvegicus
ttggctgtgagcttccacctgtgta

SEQ ID NO: 682037 - DNA, 25 bp, Rattus norvegicus
ttggctgtgagtacttggtagttac

SEQ ID NO: 682038 - DNA, 25 bp, Rattus norvegicus
ttggctgtgagttcttggtagttac

SEQ ID NO: 682039 - DNA, 25 bp, Rattus norvegicus
ttggctgtggttcacactgagctcc

SEQ ID NO: 682040 - DNA, 25 bp, Rattus norvegicus
ttggctgtggttgacactgagctcc

SEQ ID NO: 682041 - DNA, 25 bp, Rattus norvegicus
ttggctgtgtccactcgctttttca

SEQ ID NO: 682042 - DNA, 25 bp, Rattus norvegicus
ttggctgtgtcctctcgctttttca

SEQ ID NO: 682043 - DNA, 25 bp, Rattus norvegicus
ttggctgttagaccaggactgcccc

SEQ ID NO: 682044 - DNA, 25 bp, Rattus norvegicus
ttggctgttagagcaggactgcccc

SEQ ID NO: 682045 - DNA, 25 bp, Rattus norvegicus
ttggctgttcacaaaatagagcatc

SEQ ID NO: 682046 - DNA, 25 bp, Rattus norvegicus
ttggctgttcactaaatagagcatc

SEQ ID NO: 682047 - DNA, 25 bp, Rattus norvegicus
ttggctgtttccatcttcgtggcat

SEQ ID NO: 682048 - DNA, 25 bp, Rattus norvegicus
ttggctgtttccttcttcgtggcat

SEQ ID NO: 682049 - DNA, 25 bp, Rattus norvegicus
ttggcttaacacaggacacatacat

SEQ ID NO: 682050 - DNA, 25 bp, Rattus norvegicus
ttggcttaacactggacacatacat

SEQ ID NO: 682051 - DNA, 25 bp, Rattus norvegicus
ttggcttacctcagtgtgtttctaa

SEQ ID NO: 682052 - DNA, 25 bp, Rattus norvegicus
ttggcttacctctgtgtgtttctaa

SEQ ID NO: 682053 - DNA, 25 bp, Rattus norvegicus
ttggcttactgcctcatagttgtaa

SEQ ID NO: 682054 - DNA, 25 bp, Rattus norvegicus
ttggcttactgcgtcatagttgtaa

SEQ ID NO: 682055 - DNA, 25 bp, Rattus norvegicus
ttggcttcaagcatacctcaataga

SEQ ID NO: 682056 - DNA, 25 bp, Rattus norvegicus
ttggcttcaagcttacctcaataga

SEQ ID NO: 682057 - DNA, 25 bp, Rattus norvegicus
ttggcttcacacatttcagctggtt

SEQ ID NO: 682058 - DNA, 25 bp, Rattus norvegicus
ttggcttcacacttttcagctggtt

SEQ ID NO: 682059 - DNA, 25 bp, Rattus norvegicus
ttggcttcagacacaccagtgtgat

SEQ ID NO: 682060 - DNA, 25 bp, Rattus norvegicus
ttggcttcagactcaccagtgtgat

SEQ ID NO: 682061 - DNA, 25 bp, Rattus norvegicus
ttggcttcagcccacattgttgtgt

SEQ ID NO: 682062 - DNA, 25 bp, Rattus norvegicus
ttggcttcagccgacattgttgtgt

SEQ ID NO: 682063 - DNA, 25 bp, Rattus norvegicus
ttggcttcattcaggcaaattctgc

SEQ ID NO: 682064 - DNA, 25 bp, Rattus norvegicus
ttggcttcattctggcaaattctgc

SEQ ID NO: 682065 - DNA, 25 bp, Rattus norvegicus
ttggcttccaaaccgtccgaggctt

SEQ ID NO: 682066 - DNA, 25 bp, Rattus norvegicus
ttggcttccaaagcgtccgaggctt

SEQ ID NO: 682067 - DNA, 25 bp, Rattus norvegicus
ttggcttccactcgaggctgaaggt

SEQ ID NO: 682068 - DNA, 25 bp, Rattus norvegicus
ttggcttccactggaggctgaaggt

SEQ ID NO: 682069 - DNA, 25 bp, Rattus norvegicus
ttggcttccatgaaacttgcaagtt

SEQ ID NO: 682070 - DNA, 25 bp, Rattus norvegicus
ttggcttccatgtaacttgcaagtt

SEQ ID NO: 682071 - DNA, 25 bp, Rattus norvegicus
ttggcttcccagagcctgcagtggg

SEQ ID NO: 682072 - DNA, 25 bp, Rattus norvegicus
ttggcttcccagatatggaaccctt

SEQ ID NO: 682073 - DNA, 25 bp, Rattus norvegicus
ttggcttcccagcacgtgcatggtg

SEQ ID NO: 682074 - DNA, 25 bp, Rattus norvegicus
ttggcttcccaggacgtgcatggtg

SEQ ID NO: 682075 - DNA, 25 bp, Rattus norvegicus
ttggcttcccagtgcctgcagtggg

SEQ ID NO: 682076 - DNA, 25 bp, Rattus norvegicus
ttggcttcccagttatggaaccctt

SEQ ID NO: 682077 - DNA, 25 bp, Rattus norvegicus
ttggcttccctaccggactttgctc

SEQ ID NO: 682078 - DNA, 25 bp, Rattus norvegicus
ttggcttccctagcggactttgctc

SEQ ID NO: 682079 - DNA, 25 bp, Rattus norvegicus
ttggcttccctgaaggcagcgtaga

SEQ ID NO: 682080 - DNA, 25 bp, Rattus norvegicus
ttggcttccctgctgatacactgta

SEQ ID NO: 682081 - DNA, 25 bp, Rattus norvegicus
ttggcttccctggtgatacactgta

SEQ ID NO: 682082 - DNA, 25 bp, Rattus norvegicus
ttggcttccctgtaggcagcgtaga

SEQ ID NO: 682083 - DNA, 25 bp, Rattus norvegicus
ttggcttcctaccttgcaacaaaat

SEQ ID NO: 682084 - DNA, 25 bp, Rattus norvegicus
ttggcttcctacgttgcaacaaaat

SEQ ID NO: 682085 - DNA, 25 bp, Rattus norvegicus
ttggcttccttacatggccagggta

SEQ ID NO: 682086 - DNA, 25 bp, Rattus norvegicus
ttggcttccttagatggccagggta

SEQ ID NO: 682087 - DNA, 25 bp, Rattus norvegicus
ttggcttccttcatatgcttggctg

SEQ ID NO: 682088 - DNA, 25 bp, Rattus norvegicus
ttggcttccttcttatgcttggctg

SEQ ID NO: 682089 - DNA, 25 bp, Rattus norvegicus
ttggcttcctttaggattttccttg

SEQ ID NO: 682090 - DNA, 25 bp, Rattus norvegicus
ttggcttccttttggattttccttg

SEQ ID NO: 682091 - DNA, 25 bp, Rattus norvegicus
ttggcttctaaaatgtctccctact

SEQ ID NO: 682092 - DNA, 25 bp, Rattus norvegicus
ttggcttctaaattgtctccctact

SEQ ID NO: 682093 - DNA, 25 bp, Rattus norvegicus
ttggcttcttcaagctgccgtcaga

SEQ ID NO: 682094 - DNA, 25 bp, Rattus norvegicus
ttggcttcttcatgctgccgtcaga

SEQ ID NO: 682095 - DNA, 25 bp, Rattus norvegicus
ttggcttcttctcggttgagtaaag

SEQ ID NO: 682096 - DNA, 25 bp, Rattus norvegicus
ttggcttcttctgggttgagtaaag

SEQ ID NO: 682097 - DNA, 25 bp, Rattus norvegicus
ttggcttcttgtccttagctccatg

SEQ ID NO: 682098 - DNA, 25 bp, Rattus norvegicus
ttggcttcttgtgcttagctccatg

SEQ ID NO: 682099 - DNA, 25 bp, Rattus norvegicus
ttggcttctttcacacgatgcggga

SEQ ID NO: 682100 - DNA, 25 bp, Rattus norvegicus
ttggcttctttctcacgatgcggga

SEQ ID NO: 682101 - DNA, 25 bp, Rattus norvegicus
ttggcttgacaaatagacatctccc

SEQ ID NO: 682102 - DNA, 25 bp, Rattus norvegicus
ttggcttgacaattagacatctccc

SEQ ID NO: 682103 - DNA, 25 bp, Rattus norvegicus
ttggcttgaggcagttttcctggca

SEQ ID NO: 682104 - DNA, 25 bp, Rattus norvegicus
ttggcttgaggctgttttcctggca

SEQ ID NO: 682105 - DNA, 25 bp, Rattus norvegicus
ttggcttgatttacacgtggctggc

SEQ ID NO: 682106 - DNA, 25 bp, Rattus norvegicus
ttggcttgattttcacgtggctggc

SEQ ID NO: 682107 - DNA, 25 bp, Rattus norvegicus
ttggcttgcactcgcacgaaccaag

SEQ ID NO: 682108 - DNA, 25 bp, Rattus norvegicus
ttggcttgcactggcacgaaccaag

SEQ ID NO: 682109 - DNA, 25 bp, Rattus norvegicus
ttggcttgctccacagcagggaaga

SEQ ID NO: 682110 - DNA, 25 bp, Rattus norvegicus
ttggcttgctcctcagcagggaaga

SEQ ID NO: 682111 - DNA, 25 bp, Rattus norvegicus
ttggcttggcacattccaacactca

SEQ ID NO: 682112 - DNA, 25 bp, Rattus norvegicus
ttggcttggcactttccaacactca

SEQ ID NO: 682113 - DNA, 25 bp, Rattus norvegicus
ttggcttggctactagggtgttttc

SEQ ID NO: 682114 - DNA, 25 bp, Rattus norvegicus
ttggcttggctagtagggtgttttc

SEQ ID NO: 682115 - DNA, 25 bp, Rattus norvegicus
ttggcttgggtacccatttcacagt

SEQ ID NO: 682116 - DNA, 25 bp, Rattus norvegicus
ttggcttgggtagccatttcacagt

SEQ ID NO: 682117 - DNA, 25 bp, Rattus norvegicus
ttggcttggtctaccttctagggta

SEQ ID NO: 682118 - DNA, 25 bp, Rattus norvegicus
ttggcttggtcttccttctagggta

SEQ ID NO: 682119 - DNA, 25 bp, Rattus norvegicus
ttggcttgtttgagcctggcatcac

SEQ ID NO: 682120 - DNA, 25 bp, Rattus norvegicus
ttggcttgtttgtgcctggcatcac

SEQ ID NO: 682121 - DNA, 25 bp, Rattus norvegicus
ttggctttaaatacttccccgaatg

SEQ ID NO: 682122 - DNA, 25 bp, Rattus norvegicus
ttggctttaaattcttccccgaatg

SEQ ID NO: 682123 - DNA, 25 bp, Rattus norvegicus
ttggctttacttaccacaagacatg

SEQ ID NO: 682124 - DNA, 25 bp, Rattus norvegicus
ttggctttactttccacaagacatg

SEQ ID NO: 682125 - DNA, 25 bp, Rattus norvegicus
ttggctttagccaagctctgcagag

SEQ ID NO: 682126 - DNA, 25 bp, Rattus norvegicus
ttggctttagcctagctctgcagag

SEQ ID NO: 682127 - DNA, 25 bp, Rattus norvegicus
ttggctttatttccctgccagaggt

SEQ ID NO: 682128 - DNA, 25 bp, Rattus norvegicus
ttggctttatttgcctgccagaggt

SEQ ID NO: 682129 - DNA, 25 bp, Rattus norvegicus
ttggctttcaagatgtacaccccta

SEQ ID NO: 682130 - DNA, 25 bp, Rattus norvegicus
ttggctttcaagttgtacaccccta

SEQ ID NO: 682131 - DNA, 25 bp, Rattus norvegicus
ttggctttcacccttaatgctgcgg

SEQ ID NO: 682132 - DNA, 25 bp, Rattus norvegicus
ttggctttcaccgttaatgctgcgg

SEQ ID NO: 682133 - DNA, 25 bp, Rattus norvegicus
ttggctttcactagcagaccatctt

SEQ ID NO: 682134 - DNA, 25 bp, Rattus norvegicus
ttggctttcacttgcagaccatctt

SEQ ID NO: 682135 - DNA, 25 bp, Rattus norvegicus
ttggctttcaggacctctctctcca

SEQ ID NO: 682136 - DNA, 25 bp, Rattus norvegicus
ttggctttcaggtcctctctctcca

SEQ ID NO: 682137 - DNA, 25 bp, Rattus norvegicus
ttggctttccctaatatttccctct

SEQ ID NO: 682138 - DNA, 25 bp, Rattus norvegicus
ttggctttcccttatatttccctct

SEQ ID NO: 682139 - DNA, 25 bp, Rattus norvegicus
ttggctttcctcatggtgagctcct

SEQ ID NO: 682140 - DNA, 25 bp, Rattus norvegicus
ttggctttcctcttggtgagctcct

SEQ ID NO: 682141 - DNA, 25 bp, Rattus norvegicus
ttggctttccttaatcctcgtgact

SEQ ID NO: 682142 - DNA, 25 bp, Rattus norvegicus
ttggctttcctttatcctcgtgact

SEQ ID NO: 682143 - DNA, 25 bp, Rattus norvegicus
ttggctttctgacttccgaatgtga

SEQ ID NO: 682144 - DNA, 25 bp, Rattus norvegicus
ttggctttctgagttccgaatgtga

SEQ ID NO: 682145 - DNA, 25 bp, Rattus norvegicus
ttggctttgactaggctttgacacg

SEQ ID NO: 682146 - DNA, 25 bp, Rattus norvegicus
ttggctttgacttggctttgacacg

SEQ ID NO: 682147 - DNA, 25 bp, Rattus norvegicus
ttggctttggccagttgtcacaatc

SEQ ID NO: 682148 - DNA, 25 bp, Rattus norvegicus
ttggctttggccatcgtttgtaccc

SEQ ID NO: 682149 - DNA, 25 bp, Rattus norvegicus
ttggctttggcctgttgtcacaatc

SEQ ID NO: 682150 - DNA, 25 bp, Rattus norvegicus
ttggctttggccttcgtttgtaccc

SEQ ID NO: 682151 - DNA, 25 bp, Rattus norvegicus
ttggctttggctatcctggcaggca

SEQ ID NO: 682152 - DNA, 25 bp, Rattus norvegicus
ttggctttggctttcctggcaggca

SEQ ID NO: 682153 - DNA, 25 bp, Rattus norvegicus
ttggcttttccccaggacaccagga

SEQ ID NO: 682154 - DNA, 25 bp, Rattus norvegicus
ttggcttttcccgaggacaccagga

SEQ ID NO: 682155 - DNA, 25 bp, Rattus norvegicus
ttggcttttcggagtccttgaagga

SEQ ID NO: 682156 - DNA, 25 bp, Rattus norvegicus
ttggcttttcggtgtccttgaagga

SEQ ID NO: 682157 - DNA, 25 bp, Rattus norvegicus
ttggcttttcttaacattccttcct

SEQ ID NO: 682158 - DNA, 25 bp, Rattus norvegicus
ttggcttttctttacattccttcct

SEQ ID NO: 682159 - DNA, 25 bp, Rattus norvegicus
ttggctttttaaccctcttagacat

SEQ ID NO: 682160 - DNA, 25 bp, Rattus norvegicus
ttggctttttaagcctcttagacat

SEQ ID NO: 682161 - DNA, 25 bp, Rattus norvegicus
ttggctttttggcatacggtctcac

SEQ ID NO: 682162 - DNA, 25 bp, Rattus norvegicus
ttggctttttgggatacggtctcac

SEQ ID NO: 682163 - DNA, 25 bp, Rattus norvegicus
ttgggaaaactcaaaggccttctag

SEQ ID NO: 682164 - DNA, 25 bp, Rattus norvegicus
ttgggaaaactctaaggccttctag

SEQ ID NO: 682165 - DNA, 25 bp, Rattus norvegicus
ttgggaaacataccctcatccagtc

SEQ ID NO: 682166 - DNA, 25 bp, Rattus norvegicus
ttgggaaacatagcctcatccagtc

SEQ ID NO: 682167 - DNA, 25 bp, Rattus norvegicus
ttgggaaagcatagacctctcctgc

SEQ ID NO: 682168 - DNA, 25 bp, Rattus norvegicus
ttgggaaagcattgacctctcctgc

SEQ ID NO: 682169 - DNA, 25 bp, Rattus norvegicus
ttgggaaatagccacagtagacatt

SEQ ID NO: 682170 - DNA, 25 bp, Rattus norvegicus
ttgggaaatagcgacagtagacatt

SEQ ID NO: 682171 - DNA, 25 bp, Rattus norvegicus
ttgggaaatagtctctcgcttcctc

SEQ ID NO: 682172 - DNA, 25 bp, Rattus norvegicus
ttgggaaatagtgtctcgcttcctc

SEQ ID NO: 682173 - DNA, 25 bp, Rattus norvegicus
ttgggaaatgtgaaccctgagagtc

SEQ ID NO: 682174 - DNA, 25 bp, Rattus norvegicus
ttgggaaatgtgtaccctgagagtc

SEQ ID NO: 682175 - DNA, 25 bp, Rattus norvegicus
ttgggaaatttccaccttggctgct

SEQ ID NO: 682176 - DNA, 25 bp, Rattus norvegicus
ttgggaaatttcgaccttggctgct

SEQ ID NO: 682177 - DNA, 25 bp, Rattus norvegicus
ttgggaacaatgctcttgttccttc

SEQ ID NO: 682178 - DNA, 25 bp, Rattus norvegicus
ttgggaacaatggtcttgttccttc

SEQ ID NO: 682179 - DNA, 25 bp, Rattus norvegicus
ttgggaacacaacccatgccttcaa

SEQ ID NO: 682180 - DNA, 25 bp, Rattus norvegicus
ttgggaacacaagccatgccttcaa

SEQ ID NO: 682181 - DNA, 25 bp, Rattus norvegicus
ttgggaacacagagcctgctatcct

SEQ ID NO: 682182 - DNA, 25 bp, Rattus norvegicus
ttgggaacacagtgcctgctatcct

SEQ ID NO: 682183 - DNA, 25 bp, Rattus norvegicus
ttgggaaccggaccctggtcaacga

SEQ ID NO: 682184 - DNA, 25 bp, Rattus norvegicus
ttgggaaccggagcctggtcaacga

SEQ ID NO: 682185 - DNA, 25 bp, Rattus norvegicus
ttgggaacctgcagcgacctccagt

SEQ ID NO: 682186 - DNA, 25 bp, Rattus norvegicus
ttgggaacctgctgcgacctccagt

SEQ ID NO: 682187 - DNA, 25 bp, Rattus norvegicus
ttgggaactcaaaccaaggcagttt

SEQ ID NO: 682188 - DNA, 25 bp, Rattus norvegicus
ttgggaactcaatccaaggcagttt

SEQ ID NO: 682189 - DNA, 25 bp, Rattus norvegicus
ttgggaactcgcactgtgaccttag

SEQ ID NO: 682190 - DNA, 25 bp, Rattus norvegicus
ttgggaactcgctctgtgaccttag

SEQ ID NO: 682191 - DNA, 25 bp, Rattus norvegicus
ttgggaacttagcaagacccctctc

SEQ ID NO: 682192 - DNA, 25 bp, Rattus norvegicus
ttgggaacttaggaagacccctctc

SEQ ID NO: 682193 - DNA, 25 bp, Rattus norvegicus
ttgggaacttgtcgtctgtccatcc

SEQ ID NO: 682194 - DNA, 25 bp, Rattus norvegicus
ttgggaacttgtggtctgtccatcc

SEQ ID NO: 682195 - DNA, 25 bp, Rattus norvegicus
ttgggaactttccactcttcatcag

SEQ ID NO: 682196 - DNA, 25 bp, Rattus norvegicus
ttgggaactttcgactcttcatcag

SEQ ID NO: 682197 - DNA, 25 bp, Rattus norvegicus
ttgggaagaactcttaccaccctct

SEQ ID NO: 682198 - DNA, 25 bp, Rattus norvegicus
ttgggaagaactgttaccaccctct

SEQ ID NO: 682199 - DNA, 25 bp, Rattus norvegicus
ttgggaagaatcacactgctgcatt

SEQ ID NO: 682200 - DNA, 25 bp, Rattus norvegicus
ttgggaagaatctcactgctgcatt

SEQ ID NO: 682201 - DNA, 25 bp, Rattus norvegicus
ttgggaagacccacactatcctgtg

SEQ ID NO: 682202 - DNA, 25 bp, Rattus norvegicus
ttgggaagaccctcactatcctgtg

SEQ ID NO: 682203 - DNA, 25 bp, Rattus norvegicus
ttgggaagacgtacagcactggagt

SEQ ID NO: 682204 - DNA, 25 bp, Rattus norvegicus
ttgggaagacgttcagcactggagt

SEQ ID NO: 682205 - DNA, 25 bp, Rattus norvegicus
ttgggaagcagcatcaggacatttc

SEQ ID NO: 682206 - DNA, 25 bp, Rattus norvegicus
ttgggaagcagcttcaggacatttc

SEQ ID NO: 682207 - DNA, 25 bp, Rattus norvegicus
ttgggaagccttcacaatcgacctg

SEQ ID NO: 682208 - DNA, 25 bp, Rattus norvegicus
ttgggaagccttgacaatcgacctg

SEQ ID NO: 682209 - DNA, 25 bp, Rattus norvegicus
ttgggaaggccaagctcactgtggt

SEQ ID NO: 682210 - DNA, 25 bp, Rattus norvegicus
ttgggaaggccatgctcactgtggt

SEQ ID NO: 682211 - DNA, 25 bp, Rattus norvegicus
ttgggaaggcgaaagcagtgcacat

SEQ ID NO: 682212 - DNA, 25 bp, Rattus norvegicus
ttgggaaggcgatagcagtgcacat

SEQ ID NO: 682213 - DNA, 25 bp, Rattus norvegicus
ttgggaagggctccagctctacctg

SEQ ID NO: 682214 - DNA, 25 bp, Rattus norvegicus
ttgggaagggctgcagctctacctg

SEQ ID NO: 682215 - DNA, 25 bp, Rattus norvegicus
ttgggaagggtcacctcactatgag

SEQ ID NO: 682216 - DNA, 25 bp, Rattus norvegicus
ttgggaagggtctcctcactatgag

SEQ ID NO: 682217 - DNA, 25 bp, Rattus norvegicus
ttgggaaggttgacacagcgttcgt

SEQ ID NO: 682218 - DNA, 25 bp, Rattus norvegicus
ttgggaaggttgtcacagcgttcgt

SEQ ID NO: 682219 - DNA, 25 bp, Rattus norvegicus
ttgggaagtcagatcctttccttgt

SEQ ID NO: 682220 - DNA, 25 bp, Rattus norvegicus
ttgggaagtcagttcctttccttgt

SEQ ID NO: 682221 - DNA, 25 bp, Rattus norvegicus
ttgggaatggccacagctgctccat

SEQ ID NO: 682222 - DNA, 25 bp, Rattus norvegicus
ttgggaatggcctcagctgctccat

SEQ ID NO: 682223 - DNA, 25 bp, Rattus norvegicus
ttgggaatgttcaccattgctgcca

SEQ ID NO: 682224 - DNA, 25 bp, Rattus norvegicus
ttgggaatgttctccattgctgcca

SEQ ID NO: 682225 - DNA, 25 bp, Rattus norvegicus
ttgggaatgtttcactcctcccaca

SEQ ID NO: 682226 - DNA, 25 bp, Rattus norvegicus
ttgggaatgtttgactcctcccaca

SEQ ID NO: 682227 - DNA, 25 bp, Rattus norvegicus
ttgggaattcagcaggtggcacctt

SEQ ID NO: 682228 - DNA, 25 bp, Rattus norvegicus
ttgggaattcaggaggtggcacctt

SEQ ID NO: 682229 - DNA, 25 bp, Rattus norvegicus
ttgggaattctaacagcgaggtctt

SEQ ID NO: 682230 - DNA, 25 bp, Rattus norvegicus
ttgggaattctatcagcgaggtctt

SEQ ID NO: 682231 - DNA, 25 bp, Rattus norvegicus
ttgggaattgctccccagagtgact

SEQ ID NO: 682232 - DNA, 25 bp, Rattus norvegicus
ttgggaattgctgcccagagtgact

SEQ ID NO: 682233 - DNA, 25 bp, Rattus norvegicus
ttgggacaaagaccatcgactctgt

SEQ ID NO: 682234 - DNA, 25 bp, Rattus norvegicus
ttgggacaaagagcatcgactctgt

SEQ ID NO: 682235 - DNA, 25 bp, Rattus norvegicus
ttgggacaaatcagagccatcattt

SEQ ID NO: 682236 - DNA, 25 bp, Rattus norvegicus
ttgggacaaatctgagccatcattt

SEQ ID NO: 682237 - DNA, 25 bp, Rattus norvegicus
ttgggacaacctctgtagccttggc

SEQ ID NO: 682238 - DNA, 25 bp, Rattus norvegicus
ttgggacaacctgtgtagccttggc

SEQ ID NO: 682239 - DNA, 25 bp, Rattus norvegicus
ttgggacacggtcctgtcatcgcca

SEQ ID NO: 682240 - DNA, 25 bp, Rattus norvegicus
ttgggacacggtgctgtcatcgcca

SEQ ID NO: 682241 - DNA, 25 bp, Rattus norvegicus
ttgggacactcacggcagagtctct

SEQ ID NO: 682242 - DNA, 25 bp, Rattus norvegicus
ttgggacactcagggcagagtctct

SEQ ID NO: 682243 - DNA, 25 bp, Rattus norvegicus
ttgggacattccagtgcaacaacgc

SEQ ID NO: 682244 - DNA, 25 bp, Rattus norvegicus
ttgggacattcctgtgcaacaacgc

SEQ ID NO: 682245 - DNA, 25 bp, Rattus norvegicus
ttgggaccagtcaatccttggattt

SEQ ID NO: 682246 - DNA, 25 bp, Rattus norvegicus
ttgggaccagtctatccttggattt

SEQ ID NO: 682247 - DNA, 25 bp, Rattus norvegicus
ttgggaccattgaacccttagccat

SEQ ID NO: 682248 - DNA, 25 bp, Rattus norvegicus
ttgggaccattgtacccttagccat

SEQ ID NO: 682249 - DNA, 25 bp, Rattus norvegicus
ttgggacccactactaagtgtgacc

SEQ ID NO: 682250 - DNA, 25 bp, Rattus norvegicus
ttgggacccacttctaagtgtgacc

SEQ ID NO: 682251 - DNA, 25 bp, Rattus norvegicus
ttgggacccagcctcatttcaacaa

SEQ ID NO: 682252 - DNA, 25 bp, Rattus norvegicus
ttgggacccagcgtcatttcaacaa

SEQ ID NO: 682253 - DNA, 25 bp, Rattus norvegicus
ttgggacccaggaagccctagggct

SEQ ID NO: 682254 - DNA, 25 bp, Rattus norvegicus
ttgggacccaggtagccctagggct

SEQ ID NO: 682255 - DNA, 25 bp, Rattus norvegicus
ttgggaccccaaataagcatattag

SEQ ID NO: 682256 - DNA, 25 bp, Rattus norvegicus
ttgggaccccaattaagcatattag

SEQ ID NO: 682257 - DNA, 25 bp, Rattus norvegicus
ttgggacccctgaagtcagcaagcc

SEQ ID NO: 682258 - DNA, 25 bp, Rattus norvegicus
ttgggacccctgtagtcagcaagcc

SEQ ID NO: 682259 - DNA, 25 bp, Rattus norvegicus
ttgggaccctttcccatttgtcaaa

SEQ ID NO: 682260 - DNA, 25 bp, Rattus norvegicus
ttgggaccctttgccatttgtcaaa

SEQ ID NO: 682261 - DNA, 25 bp, Rattus norvegicus
ttgggaccgattcgcagtaggctat

SEQ ID NO: 682262 - DNA, 25 bp, Rattus norvegicus
ttgggaccgattggcagtaggctat

SEQ ID NO: 682263 - DNA, 25 bp, Rattus norvegicus
ttgggacctcccaggccgttgggca

SEQ ID NO: 682264 - DNA, 25 bp, Rattus norvegicus
ttgggacctccctggccgttgggca

SEQ ID NO: 682265 - DNA, 25 bp, Rattus norvegicus
ttgggacctggcaatggaagctatt

SEQ ID NO: 682266 - DNA, 25 bp, Rattus norvegicus
ttgggacctggcatctacagcaacc

SEQ ID NO: 682267 - DNA, 25 bp, Rattus norvegicus
ttgggacctggctatggaagctatt

SEQ ID NO: 682268 - DNA, 25 bp, Rattus norvegicus
ttgggacctggcttctacagcaacc

SEQ ID NO: 682269 - DNA, 25 bp, Rattus norvegicus
ttgggaccttagaccttagactgcc

SEQ ID NO: 682270 - DNA, 25 bp, Rattus norvegicus
ttgggaccttagtccttagactgcc

SEQ ID NO: 682271 - DNA, 25 bp, Rattus norvegicus
ttgggacgacacaacctatttgaag

SEQ ID NO: 682272 - DNA, 25 bp, Rattus norvegicus
ttgggacgacactacctatttgaag

SEQ ID NO: 682273 - DNA, 25 bp, Rattus norvegicus
ttgggactatgccatcgggttctac

SEQ ID NO: 682274 - DNA, 25 bp, Rattus norvegicus
ttgggactatgcgatcgggttctac

SEQ ID NO: 682275 - DNA, 25 bp, Rattus norvegicus
ttgggactcagtatcttcgtataga

SEQ ID NO: 682276 - DNA, 25 bp, Rattus norvegicus
ttgggactcagtttcttcgtataga

SEQ ID NO: 682277 - DNA, 25 bp, Rattus norvegicus
ttgggactgaccaaaggcctctctg

SEQ ID NO: 682278 - DNA, 25 bp, Rattus norvegicus
ttgggactgacctaaggcctctctg

SEQ ID NO: 682279 - DNA, 25 bp, Rattus norvegicus
ttgggactgccactttcagaatcgt

SEQ ID NO: 682280 - DNA, 25 bp, Rattus norvegicus
ttgggactgccagtttcagaatcgt

SEQ ID NO: 682281 - DNA, 25 bp, Rattus norvegicus
ttgggactggcaccttacatgctcc

SEQ ID NO: 682282 - DNA, 25 bp, Rattus norvegicus
ttgggactggcagcttacatgctcc

SEQ ID NO: 682283 - DNA, 25 bp, Rattus norvegicus
ttgggacttgctaacctatactcag

SEQ ID NO: 682284 - DNA, 25 bp, Rattus norvegicus
ttgggacttgcttacctatactcag

SEQ ID NO: 682285 - DNA, 25 bp, Rattus norvegicus
ttgggacttggtaataactgtagca

SEQ ID NO: 682286 - DNA, 25 bp, Rattus norvegicus
ttgggacttggttataactgtagca

SEQ ID NO: 682287 - DNA, 25 bp, Rattus norvegicus
ttgggagacccgactattcctgcag

SEQ ID NO: 682288 - DNA, 25 bp, Rattus norvegicus
ttgggagacccgcttttgtacaaag

SEQ ID NO: 682289 - DNA, 25 bp, Rattus norvegicus
ttgggagacccggttttgtacaaag

SEQ ID NO: 682290 - DNA, 25 bp, Rattus norvegicus
ttgggagacccgtctattcctgcag

SEQ ID NO: 682291 - DNA, 25 bp, Rattus norvegicus
ttgggagagcctagagccacctaat

SEQ ID NO: 682292 - DNA, 25 bp, Rattus norvegicus
ttgggagagccttgagccacctaat

SEQ ID NO: 682293 - DNA, 25 bp, Rattus norvegicus
ttgggagagggtcgatcttttgctt

SEQ ID NO: 682294 - DNA, 25 bp, Rattus norvegicus
ttgggagagggtggatcttttgctt

SEQ ID NO: 682295 - DNA, 25 bp, Rattus norvegicus
ttgggagatcccctacagagggcca

SEQ ID NO: 682296 - DNA, 25 bp, Rattus norvegicus
ttgggagatcccgtacagagggcca

SEQ ID NO: 682297 - DNA, 25 bp, Rattus norvegicus
ttgggagcatgaacacctccgtgta

SEQ ID NO: 682298 - DNA, 25 bp, Rattus norvegicus
ttgggagcatgatcacctccgtgta

SEQ ID NO: 682299 - DNA, 25 bp, Rattus norvegicus
ttgggagccatgcttgggatggtca

SEQ ID NO: 682300 - DNA, 25 bp, Rattus norvegicus
ttgggagccatggttgggatggtca

SEQ ID NO: 682301 - DNA, 25 bp, Rattus norvegicus
ttgggagccctacaacaacagctat

SEQ ID NO: 682302 - DNA, 25 bp, Rattus norvegicus
ttgggagccctagaacaacagctat

SEQ ID NO: 682303 - DNA, 25 bp, Rattus norvegicus
ttgggagccgctccatttcaaagga

SEQ ID NO: 682304 - DNA, 25 bp, Rattus norvegicus
ttgggagccgctgcatttcaaagga

SEQ ID NO: 682305 - DNA, 25 bp, Rattus norvegicus
ttgggagccgtccagcactgctact

SEQ ID NO: 682306 - DNA, 25 bp, Rattus norvegicus
ttgggagccgtcgagcactgctact

SEQ ID NO: 682307 - DNA, 25 bp, Rattus norvegicus
ttgggagcgcgtcccttaaggacca

SEQ ID NO: 682308 - DNA, 25 bp, Rattus norvegicus
ttgggagcgcgtgccttaaggacca

SEQ ID NO: 682309 - DNA, 25 bp, Rattus norvegicus
ttgggagctccacgcaaggatgtca

SEQ ID NO: 682310 - DNA, 25 bp, Rattus norvegicus
ttgggagctccaggcaaggatgtca

SEQ ID NO: 682311 - DNA, 25 bp, Rattus norvegicus
ttgggagctcctagctggaaggaaa

SEQ ID NO: 682312 - DNA, 25 bp, Rattus norvegicus
ttgggagctccttgctggaaggaaa

SEQ ID NO: 682313 - DNA, 25 bp, Rattus norvegicus
ttgggagctgctcggcacccacagc

SEQ ID NO: 682314 - DNA, 25 bp, Rattus norvegicus
ttgggagctgctgggcacccacagc

SEQ ID NO: 682315 - DNA, 25 bp, Rattus norvegicus
ttgggaggtcctactcaagggtctc

SEQ ID NO: 682316 - DNA, 25 bp, Rattus norvegicus
ttgggaggtccttctcaagggtctc

SEQ ID NO: 682317 - DNA, 25 bp, Rattus norvegicus
ttgggaggttctctccaaccatgtc

SEQ ID NO: 682318 - DNA, 25 bp, Rattus norvegicus
ttgggaggttctgtccaaccatgtc

SEQ ID NO: 682319 - DNA, 25 bp, Rattus norvegicus
ttgggagtatcaaccttctagcctc

SEQ ID NO: 682320 - DNA, 25 bp, Rattus norvegicus
ttgggagtatcatccttctagcctc

SEQ ID NO: 682321 - DNA, 25 bp, Rattus norvegicus
ttgggagtcctcatttagaccagca

SEQ ID NO: 682322 - DNA, 25 bp, Rattus norvegicus
ttgggagtcctcttttagaccagca

SEQ ID NO: 682323 - DNA, 25 bp, Rattus norvegicus
ttgggagtctccctgttaaaacact

SEQ ID NO: 682324 - DNA, 25 bp, Rattus norvegicus
ttgggagtctccgtgttaaaacact

SEQ ID NO: 682325 - DNA, 25 bp, Rattus norvegicus
ttgggagtgtccagcctctctctta

SEQ ID NO: 682326 - DNA, 25 bp, Rattus norvegicus
ttgggagtgtcctgcctctctctta

SEQ ID NO: 682327 - DNA, 25 bp, Rattus norvegicus
ttgggagttcttcagggcatctttc

SEQ ID NO: 682328 - DNA, 25 bp, Rattus norvegicus
ttgggagttcttgagggcatctttc

SEQ ID NO: 682329 - DNA, 25 bp, Rattus norvegicus
ttgggataaattagcccctcctggt

SEQ ID NO: 682330 - DNA, 25 bp, Rattus norvegicus
ttgggataaatttgcccctcctggt

SEQ ID NO: 682331 - DNA, 25 bp, Rattus norvegicus
ttgggataactgctggcaccttcat

SEQ ID NO: 682332 - DNA, 25 bp, Rattus norvegicus
ttgggataactggtggcaccttcat

SEQ ID NO: 682333 - DNA, 25 bp, Rattus norvegicus
ttgggataatctaacaccttccctc

SEQ ID NO: 682334 - DNA, 25 bp, Rattus norvegicus
ttgggataatcttacaccttccctc

SEQ ID NO: 682335 - DNA, 25 bp, Rattus norvegicus
ttgggatagcagacacactgtgtgg

SEQ ID NO: 682336 - DNA, 25 bp, Rattus norvegicus
ttgggatagcagtcacactgtgtgg

SEQ ID NO: 682337 - DNA, 25 bp, Rattus norvegicus
ttgggatagctaaacccgtttctag

SEQ ID NO: 682338 - DNA, 25 bp, Rattus norvegicus
ttgggatagctatacccgtttctag

SEQ ID NO: 682339 - DNA, 25 bp, Rattus norvegicus
ttgggatcaatgacaggaaccctgc

SEQ ID NO: 682340 - DNA, 25 bp, Rattus norvegicus
ttgggatcaatgtcaggaaccctgc

SEQ ID NO: 682341 - DNA, 25 bp, Rattus norvegicus
ttgggatcctctagggctgctcagc

SEQ ID NO: 682342 - DNA, 25 bp, Rattus norvegicus
ttgggatcctcttgggctgctcagc

SEQ ID NO: 682343 - DNA, 25 bp, Rattus norvegicus
ttgggatgacacactgctgcctcaa

SEQ ID NO: 682344 - DNA, 25 bp, Rattus norvegicus
ttgggatgacactctgctgcctcaa

SEQ ID NO: 682345 - DNA, 25 bp, Rattus norvegicus
ttgggatgacataacttaccgacat

SEQ ID NO: 682346 - DNA, 25 bp, Rattus norvegicus
ttgggatgacattacttaccgacat

SEQ ID NO: 682347 - DNA, 25 bp, Rattus norvegicus
ttgggatgaccaagtttctcctcgt

SEQ ID NO: 682348 - DNA, 25 bp, Rattus norvegicus
ttgggatgaccatgtttctcctcgt

SEQ ID NO: 682349 - DNA, 25 bp, Rattus norvegicus
ttgggatgatgcctgccttacctac

SEQ ID NO: 682350 - DNA, 25 bp, Rattus norvegicus
ttgggatgatgcgtgccttacctac

SEQ ID NO: 682351 - DNA, 25 bp, Rattus norvegicus
ttgggatgggcaacacaaccccacc

SEQ ID NO: 682352 - DNA, 25 bp, Rattus norvegicus
ttgggatgggcatcacaaccccacc

SEQ ID NO: 682353 - DNA, 25 bp, Rattus norvegicus
ttgggatgggccaaagtagctcttt

SEQ ID NO: 682354 - DNA, 25 bp, Rattus norvegicus
ttgggatgggcctaagtagctcttt

SEQ ID NO: 682355 - DNA, 25 bp, Rattus norvegicus
ttgggattatatccacactaccatc

SEQ ID NO: 682356 - DNA, 25 bp, Rattus norvegicus
ttgggattatatgcacactaccatc

SEQ ID NO: 682357 - DNA, 25 bp, Rattus norvegicus
ttgggattccagagacacaccttta

SEQ ID NO: 682358 - DNA, 25 bp, Rattus norvegicus
ttgggattccagtgacacaccttta

SEQ ID NO: 682359 - DNA, 25 bp, Rattus norvegicus
ttgggattccgaactgcagcgggaa

SEQ ID NO: 682360 - DNA, 25 bp, Rattus norvegicus
ttgggattccgatctgcagcgggaa

SEQ ID NO: 682361 - DNA, 25 bp, Rattus norvegicus
ttgggattcgaaacctttgcaggca

SEQ ID NO: 682362 - DNA, 25 bp, Rattus norvegicus
ttgggattcgaatcctttgcaggca

SEQ ID NO: 682363 - DNA, 25 bp, Rattus norvegicus
ttgggattctcgattgctgcctgac

SEQ ID NO: 682364 - DNA, 25 bp, Rattus norvegicus
ttgggattctcgtttgctgcctgac

SEQ ID NO: 682365 - DNA, 25 bp, Rattus norvegicus
ttgggatttgtgcttcagtcttgct

SEQ ID NO: 682366 - DNA, 25 bp, Rattus norvegicus
ttgggatttgtggttcagtcttgct

SEQ ID NO: 682367 - DNA, 25 bp, Rattus norvegicus
ttgggcaaaagcaccctgcagctgc

SEQ ID NO: 682368 - DNA, 25 bp, Rattus norvegicus
ttgggcaaaagctccctgcagctgc

SEQ ID NO: 682369 - DNA, 25 bp, Rattus norvegicus
ttgggcaaagccaactcttactcag

SEQ ID NO: 682370 - DNA, 25 bp, Rattus norvegicus
ttgggcaaagcctactcttactcag

SEQ ID NO: 682371 - DNA, 25 bp, Rattus norvegicus
ttgggcaaagctatcctgtatggga

SEQ ID NO: 682372 - DNA, 25 bp, Rattus norvegicus
ttgggcaaagctttcctgtatggga

SEQ ID NO: 682373 - DNA, 25 bp, Rattus norvegicus
ttgggcaaatcaccccgactgcttg

SEQ ID NO: 682374 - DNA, 25 bp, Rattus norvegicus
ttgggcaaatcagcccgactgcttg

SEQ ID NO: 682375 - DNA, 25 bp, Rattus norvegicus
ttgggcaacactcctgttcctcaca

SEQ ID NO: 682376 - DNA, 25 bp, Rattus norvegicus
ttgggcaacactgctgttcctcaca

SEQ ID NO: 682377 - DNA, 25 bp, Rattus norvegicus
ttgggcaaccagcaggccatccagg

SEQ ID NO: 682378 - DNA, 25 bp, Rattus norvegicus
ttgggcaaccaggaggccatccagg

SEQ ID NO: 682379 - DNA, 25 bp, Rattus norvegicus
ttgggcaagcctcgcaatgttggca

SEQ ID NO: 682380 - DNA, 25 bp, Rattus norvegicus
ttgggcaagcctggcaatgttggca

SEQ ID NO: 682381 - DNA, 25 bp, Rattus norvegicus
ttgggcaagctaaagaaccgtcatt

SEQ ID NO: 682382 - DNA, 25 bp, Rattus norvegicus
ttgggcaagctatagaaccgtcatt

SEQ ID NO: 682383 - DNA, 25 bp, Rattus norvegicus
ttgggcacacttctggcaatacaca

SEQ ID NO: 682384 - DNA, 25 bp, Rattus norvegicus
ttgggcacacttgtggcaatacaca

SEQ ID NO: 682385 - DNA, 25 bp, Rattus norvegicus
ttgggcacagccctgaaggccaatc

SEQ ID NO: 682386 - DNA, 25 bp, Rattus norvegicus
ttgggcacagccgtgaaggccaatc

SEQ ID NO: 682387 - DNA, 25 bp, Rattus norvegicus
ttgggcacatgaactcttcccttgg

SEQ ID NO: 682388 - DNA, 25 bp, Rattus norvegicus
ttgggcacatgatctcttcccttgg

SEQ ID NO: 682389 - DNA, 25 bp, Rattus norvegicus
ttgggcaccaggcagcgccatctgc

SEQ ID NO: 682390 - DNA, 25 bp, Rattus norvegicus
ttgggcaccagggagcgccatctgc

SEQ ID NO: 682391 - DNA, 25 bp, Rattus norvegicus
ttgggcaccatgatggccacctcaa

SEQ ID NO: 682392 - DNA, 25 bp, Rattus norvegicus
ttgggcaccatgttggccacctcaa

SEQ ID NO: 682393 - DNA, 25 bp, Rattus norvegicus
ttgggcacccggctctggatgttct

SEQ ID NO: 682394 - DNA, 25 bp, Rattus norvegicus
ttgggcacccgggtctggatgttct

SEQ ID NO: 682395 - DNA, 25 bp, Rattus norvegicus
ttgggcacctggaacacgaactcct

SEQ ID NO: 682396 - DNA, 25 bp, Rattus norvegicus
ttgggcacctggtacacgaactcct

SEQ ID NO: 682397 - DNA, 25 bp, Rattus norvegicus
ttgggcacctttcaaactctggact

SEQ ID NO: 682398 - DNA, 25 bp, Rattus norvegicus
ttgggcacctttgaaactctggact

SEQ ID NO: 682399 - DNA, 25 bp, Rattus norvegicus
ttgggcacgctgcacaggctgtcac

SEQ ID NO: 682400 - DNA, 25 bp, Rattus norvegicus
ttgggcacgctggacaggctgtcac

SEQ ID NO: 682401 - DNA, 25 bp, Rattus norvegicus
ttgggcacggtgactgtcttcctaa

SEQ ID NO: 682402 - DNA, 25 bp, Rattus norvegicus
ttgggcacggtgtctgtcttcctaa

SEQ ID NO: 682403 - DNA, 25 bp, Rattus norvegicus
ttgggcactcagagtcaccgcattc

SEQ ID NO: 682404 - DNA, 25 bp, Rattus norvegicus
ttgggcactcagtgtcaccgcattc

SEQ ID NO: 682405 - DNA, 25 bp, Rattus norvegicus
ttgggcactgagacaaacttggcat

SEQ ID NO: 682406 - DNA, 25 bp, Rattus norvegicus
ttgggcactgagtcaaacttggcat

SEQ ID NO: 682407 - DNA, 25 bp, Rattus norvegicus
ttgggcagatggctccttaggtaaa

SEQ ID NO: 682408 - DNA, 25 bp, Rattus norvegicus
ttgggcagatgggtccttaggtaaa

SEQ ID NO: 682409 - DNA, 25 bp, Rattus norvegicus
ttgggcagccagattctagccaaat

SEQ ID NO: 682410 - DNA, 25 bp, Rattus norvegicus
ttgggcagccagtttctagccaaat

SEQ ID NO: 682411 - DNA, 25 bp, Rattus norvegicus
ttgggcagcgttcgtgctcttcagc

SEQ ID NO: 682412 - DNA, 25 bp, Rattus norvegicus
ttgggcagcgttggtgctcttcagc

SEQ ID NO: 682413 - DNA, 25 bp, Rattus norvegicus
ttgggcaggacaagcagccccacct

SEQ ID NO: 682414 - DNA, 25 bp, Rattus norvegicus
ttgggcaggacatgcagccccacct

SEQ ID NO: 682415 - DNA, 25 bp, Rattus norvegicus
ttgggcagggctaccaggaactgat

SEQ ID NO: 682416 - DNA, 25 bp, Rattus norvegicus
ttgggcagggcttccaggaactgat

SEQ ID NO: 682417 - DNA, 25 bp, Rattus norvegicus
ttgggcagtgccacgaggacaccga

SEQ ID NO: 682418 - DNA, 25 bp, Rattus norvegicus
ttgggcagtgcctcgaggacaccga

SEQ ID NO: 682419 - DNA, 25 bp, Rattus norvegicus
ttgggcatccaaatctactaacttt

SEQ ID NO: 682420 - DNA, 25 bp, Rattus norvegicus
ttgggcatccaattctactaacttt

SEQ ID NO: 682421 - DNA, 25 bp, Rattus norvegicus
ttgggcatcccacaaactcaagagc

SEQ ID NO: 682422 - DNA, 25 bp, Rattus norvegicus
ttgggcatcccacgttaatacatgt

SEQ ID NO: 682423 - DNA, 25 bp, Rattus norvegicus
ttgggcatcccagaaactcaagagc

SEQ ID NO: 682424 - DNA, 25 bp, Rattus norvegicus
ttgggcatcccaggttaatacatgt

SEQ ID NO: 682425 - DNA, 25 bp, Rattus norvegicus
ttgggcatcgtcagaggacctgctc

SEQ ID NO: 682426 - DNA, 25 bp, Rattus norvegicus
ttgggcatcgtctgaggacctgctc

SEQ ID NO: 682427 - DNA, 25 bp, Rattus norvegicus
ttgggcatgccaaacacacaggtat

SEQ ID NO: 682428 - DNA, 25 bp, Rattus norvegicus
ttgggcatgccatacacacaggtat

SEQ ID NO: 682429 - DNA, 25 bp, Rattus norvegicus
ttgggcatgctacacagaccttcag

SEQ ID NO: 682430 - DNA, 25 bp, Rattus norvegicus
ttgggcatgctagacagaccttcag

SEQ ID NO: 682431 - DNA, 25 bp, Rattus norvegicus
ttgggcattagaccaaaggccattc

SEQ ID NO: 682432 - DNA, 25 bp, Rattus norvegicus
ttgggcattagagcaaaggccattc

SEQ ID NO: 682433 - DNA, 25 bp, Rattus norvegicus
ttgggcattggtcgaccctcaggct

SEQ ID NO: 682434 - DNA, 25 bp, Rattus norvegicus
ttgggcattggtggaccctcaggct

SEQ ID NO: 682435 - DNA, 25 bp, Rattus norvegicus
ttgggcatttgtccggaatccagca

SEQ ID NO: 682436 - DNA, 25 bp, Rattus norvegicus
ttgggcatttgtgcggaatccagca

SEQ ID NO: 682437 - DNA, 25 bp, Rattus norvegicus
ttgggccaaagacccttcctctaga

SEQ ID NO: 682438 - DNA, 25 bp, Rattus norvegicus
ttgggccaaagagccttcctctaga

SEQ ID NO: 682439 - DNA, 25 bp, Rattus norvegicus
ttgggccaacatatatcagaggatt

SEQ ID NO: 682440 - DNA, 25 bp, Rattus norvegicus
ttgggccaacatcgccagagtttgc

SEQ ID NO: 682441 - DNA, 25 bp, Rattus norvegicus
ttgggccaacatggccagagtttgc

SEQ ID NO: 682442 - DNA, 25 bp, Rattus norvegicus
ttgggccaacatttatcagaggatt

SEQ ID NO: 682443 - DNA, 25 bp, Rattus norvegicus
ttgggccaccaaatgtatgcacagt

SEQ ID NO: 682444 - DNA, 25 bp, Rattus norvegicus
ttgggccaccaattgtatgcacagt

SEQ ID NO: 682445 - DNA, 25 bp, Rattus norvegicus
ttgggccaccacctgggcaaggaat

SEQ ID NO: 682446 - DNA, 25 bp, Rattus norvegicus
ttgggccaccacgtgggcaaggaat

SEQ ID NO: 682447 - DNA, 25 bp, Rattus norvegicus
ttgggccaccttatgggcaaggcgc

SEQ ID NO: 682448 - DNA, 25 bp, Rattus norvegicus
ttgggccaccttttgggcaaggcgc

SEQ ID NO: 682449 - DNA, 25 bp, Rattus norvegicus
ttgggccactggcagtttgcataat

SEQ ID NO: 682450 - DNA, 25 bp, Rattus norvegicus
ttgggccactgggagtttgcataat

SEQ ID NO: 682451 - DNA, 25 bp, Rattus norvegicus
ttgggccacttaatgttacctcaga

SEQ ID NO: 682452 - DNA, 25 bp, Rattus norvegicus
ttgggccacttattgttacctcaga

SEQ ID NO: 682453 - DNA, 25 bp, Rattus norvegicus
ttgggccagactcttttccgttcgt

SEQ ID NO: 682454 - DNA, 25 bp, Rattus norvegicus
ttgggccagactgttttccgttcgt

SEQ ID NO: 682455 - DNA, 25 bp, Rattus norvegicus
ttgggccagccaagtgtctgcgctt

SEQ ID NO: 682456 - DNA, 25 bp, Rattus norvegicus
ttgggccagccatgtgtctgcgctt

SEQ ID NO: 682457 - DNA, 25 bp, Rattus norvegicus
ttgggccagctaaacatgcttcatc

SEQ ID NO: 682458 - DNA, 25 bp, Rattus norvegicus
ttgggccagctatacatgcttcatc

SEQ ID NO: 682459 - DNA, 25 bp, Rattus norvegicus
ttgggccagtttaggaccagagcac

SEQ ID NO: 682460 - DNA, 25 bp, Rattus norvegicus
ttgggccagttttggaccagagcac

SEQ ID NO: 682461 - DNA, 25 bp, Rattus norvegicus
ttgggccatagcctaagtcattagt

SEQ ID NO: 682462 - DNA, 25 bp, Rattus norvegicus
ttgggccatagcgtaagtcattagt

SEQ ID NO: 682463 - DNA, 25 bp, Rattus norvegicus
ttgggccatgttaacctgtgttcac

SEQ ID NO: 682464 - DNA, 25 bp, Rattus norvegicus
ttgggccatgtttacctgtgttcac

SEQ ID NO: 682465 - DNA, 25 bp, Rattus norvegicus
ttgggccattgtctgatgcctgcac

SEQ ID NO: 682466 - DNA, 25 bp, Rattus norvegicus
ttgggccattgtgtgatgcctgcac

SEQ ID NO: 682467 - DNA, 25 bp, Rattus norvegicus
ttgggcccaataaatttcactactg

SEQ ID NO: 682468 - DNA, 25 bp, Rattus norvegicus
ttgggcccaatatatttcactactg

SEQ ID NO: 682469 - DNA, 25 bp, Rattus norvegicus
ttgggcccagcaagactacacagca

SEQ ID NO: 682470 - DNA, 25 bp, Rattus norvegicus
ttgggcccagcatgactacacagca

SEQ ID NO: 682471 - DNA, 25 bp, Rattus norvegicus
ttgggcccagcccaacaggaacaga

SEQ ID NO: 682472 - DNA, 25 bp, Rattus norvegicus
ttgggcccagccgaacaggaacaga

SEQ ID NO: 682473 - DNA, 25 bp, Rattus norvegicus
ttgggcccatataacccagacactt

SEQ ID NO: 682474 - DNA, 25 bp, Rattus norvegicus
ttgggcccatattacccagacactt

SEQ ID NO: 682475 - DNA, 25 bp, Rattus norvegicus
ttgggccccgctaagttgacctcca

SEQ ID NO: 682476 - DNA, 25 bp, Rattus norvegicus
ttgggccccgcttagttgacctcca

SEQ ID NO: 682477 - DNA, 25 bp, Rattus norvegicus
ttgggcccctggaattacatctcta

SEQ ID NO: 682478 - DNA, 25 bp, Rattus norvegicus
ttgggcccctggtattacatctcta

SEQ ID NO: 682479 - DNA, 25 bp, Rattus norvegicus
ttgggcccgagacagctagacgtcc

SEQ ID NO: 682480 - DNA, 25 bp, Rattus norvegicus
ttgggcccgagagagctagacgtcc

SEQ ID NO: 682481 - DNA, 25 bp, Rattus norvegicus
ttgggcccttttctaacttctctga

SEQ ID NO: 682482 - DNA, 25 bp, Rattus norvegicus
ttgggcccttttgtaacttctctga

SEQ ID NO: 682483 - DNA, 25 bp, Rattus norvegicus
ttgggccgaagtacaggtttccatg

SEQ ID NO: 682484 - DNA, 25 bp, Rattus norvegicus
ttgggccgaagttcaggtttccatg

SEQ ID NO: 682485 - DNA, 25 bp, Rattus norvegicus
ttgggccgaataccagccaatggcg

SEQ ID NO: 682486 - DNA, 25 bp, Rattus norvegicus
ttgggccgaatagcagccaatggcg

SEQ ID NO: 682487 - DNA, 25 bp, Rattus norvegicus
ttgggccgacgtctttattatctct

SEQ ID NO: 682488 - DNA, 25 bp, Rattus norvegicus
ttgggccgacgtgtttattatctct

SEQ ID NO: 682489 - DNA, 25 bp, Rattus norvegicus
ttgggccgatttacagcgccagtct

SEQ ID NO: 682490 - DNA, 25 bp, Rattus norvegicus
ttgggccgattttcagcgccagtct

SEQ ID NO: 682491 - DNA, 25 bp, Rattus norvegicus
ttgggcctacttcgcctgtagtcct

SEQ ID NO: 682492 - DNA, 25 bp, Rattus norvegicus
ttgggcctacttggcctgtagtcct

SEQ ID NO: 682493 - DNA, 25 bp, Rattus norvegicus
ttgggcctcaccaagctgtcgtgag

SEQ ID NO: 682494 - DNA, 25 bp, Rattus norvegicus
ttgggcctcacctagctgtcgtgag

SEQ ID NO: 682495 - DNA, 25 bp, Rattus norvegicus
ttgggcctcatacctcatgtaatca

SEQ ID NO: 682496 - DNA, 25 bp, Rattus norvegicus
ttgggcctcatagctcatgtaatca

SEQ ID NO: 682497 - DNA, 25 bp, Rattus norvegicus
ttgggcctcgcacacacttagctgg

SEQ ID NO: 682498 - DNA, 25 bp, Rattus norvegicus
ttgggcctcgcagacacttagctgg

SEQ ID NO: 682499 - DNA, 25 bp, Rattus norvegicus
ttgggcctctaacctgtttttgctt

SEQ ID NO: 682500 - DNA, 25 bp, Rattus norvegicus
ttgggcctctaagctgtttttgctt

SEQ ID NO: 682501 - DNA, 25 bp, Rattus norvegicus
ttgggcctcttcaaatactttcttc

SEQ ID NO: 682502 - DNA, 25 bp, Rattus norvegicus
ttgggcctcttctaatactttcttc

SEQ ID NO: 682503 - DNA, 25 bp, Rattus norvegicus
ttgggcctgcttatacctctgttgt

SEQ ID NO: 682504 - DNA, 25 bp, Rattus norvegicus
ttgggcctgcttttacctctgttgt

SEQ ID NO: 682505 - DNA, 25 bp, Rattus norvegicus
ttgggccttcaacttgtatgacctc

SEQ ID NO: 682506 - DNA, 25 bp, Rattus norvegicus
ttgggccttcaagttgtatgacctc

SEQ ID NO: 682507 - DNA, 25 bp, Rattus norvegicus
ttgggccttcctaggaaaagcctgt

SEQ ID NO: 682508 - DNA, 25 bp, Rattus norvegicus
ttgggccttccttggaaaagcctgt

SEQ ID NO: 682509 - DNA, 25 bp, Rattus norvegicus
ttgggccttctgaaatgttctagct

SEQ ID NO: 682510 - DNA, 25 bp, Rattus norvegicus
ttgggccttctgtaatgttctagct

SEQ ID NO: 682511 - DNA, 25 bp, Rattus norvegicus
ttgggccttgccaagccggttagcc

SEQ ID NO: 682512 - DNA, 25 bp, Rattus norvegicus
ttgggccttgcctagccggttagcc

SEQ ID NO: 682513 - DNA, 25 bp, Rattus norvegicus
ttgggcctttgaaaggtccaccagg

SEQ ID NO: 682514 - DNA, 25 bp, Rattus norvegicus
ttgggcctttgataggtccaccagg

SEQ ID NO: 682515 - DNA, 25 bp, Rattus norvegicus
ttgggcctttgcactgaaccatcat

SEQ ID NO: 682516 - DNA, 25 bp, Rattus norvegicus
ttgggcctttgctctgaaccatcat

SEQ ID NO: 682517 - DNA, 25 bp, Rattus norvegicus
ttgggcctttgtcgctacacagtct

SEQ ID NO: 682518 - DNA, 25 bp, Rattus norvegicus
ttgggcctttgtggctacacagtct

SEQ ID NO: 682519 - DNA, 25 bp, Rattus norvegicus
ttgggccttttccacagctgatgct

SEQ ID NO: 682520 - DNA, 25 bp, Rattus norvegicus
ttgggccttttcgacagctgatgct

SEQ ID NO: 682521 - DNA, 25 bp, Rattus norvegicus
ttgggcgacagtcgagacttcacgt

SEQ ID NO: 682522 - DNA, 25 bp, Rattus norvegicus
ttgggcgacagtggagacttcacgt

SEQ ID NO: 682523 - DNA, 25 bp, Rattus norvegicus
ttgggcgcctgtcttccacttggca

SEQ ID NO: 682524 - DNA, 25 bp, Rattus norvegicus
ttgggcgcctgtgttccacttggca

SEQ ID NO: 682525 - DNA, 25 bp, Rattus norvegicus
ttgggcgcgcatatgagcggctcta

SEQ ID NO: 682526 - DNA, 25 bp, Rattus norvegicus
ttgggcgcgcatttgagcggctcta

SEQ ID NO: 682527 - DNA, 25 bp, Rattus norvegicus
ttgggcgtcttaagctccaactaac

SEQ ID NO: 682528 - DNA, 25 bp, Rattus norvegicus
ttgggcgtcttatgctccaactaac

SEQ ID NO: 682529 - DNA, 25 bp, Rattus norvegicus
ttgggcgtttcgatacagtaatata

SEQ ID NO: 682530 - DNA, 25 bp, Rattus norvegicus
ttgggcgtttcgttacagtaatata

SEQ ID NO: 682531 - DNA, 25 bp, Rattus norvegicus
ttgggcgtttttctatcatcgataa

SEQ ID NO: 682532 - DNA, 25 bp, Rattus norvegicus
ttgggcgtttttgtatcatcgataa

SEQ ID NO: 682533 - DNA, 25 bp, Rattus norvegicus
ttgggctaagcaatgccctgctggg

SEQ ID NO: 682534 - DNA, 25 bp, Rattus norvegicus
ttgggctaagcattgccctgctggg

SEQ ID NO: 682535 - DNA, 25 bp, Rattus norvegicus
ttgggctaagtgctcctggacttga

SEQ ID NO: 682536 - DNA, 25 bp, Rattus norvegicus
ttgggctaagtggtcctggacttga

SEQ ID NO: 682537 - DNA, 25 bp, Rattus norvegicus
ttgggctaccccaactttgtggcaa

SEQ ID NO: 682538 - DNA, 25 bp, Rattus norvegicus
ttgggctacccctactttgtggcaa

SEQ ID NO: 682539 - DNA, 25 bp, Rattus norvegicus
ttgggctactgacctttgaattaac

SEQ ID NO: 682540 - DNA, 25 bp, Rattus norvegicus
ttgggctactgagctttgaattaac

SEQ ID NO: 682541 - DNA, 25 bp, Rattus norvegicus
ttgggctagaagcttccagcaggct

SEQ ID NO: 682542 - DNA, 25 bp, Rattus norvegicus
ttgggctagaaggttccagcaggct

SEQ ID NO: 682543 - DNA, 25 bp, Rattus norvegicus
ttgggctagagtaccatccatcctt

SEQ ID NO: 682544 - DNA, 25 bp, Rattus norvegicus
ttgggctagagttccatccatcctt

SEQ ID NO: 682545 - DNA, 25 bp, Rattus norvegicus
ttgggctagtccctaacttagagtc

SEQ ID NO: 682546 - DNA, 25 bp, Rattus norvegicus
ttgggctagtccgtaacttagagtc

SEQ ID NO: 682547 - DNA, 25 bp, Rattus norvegicus
ttgggctatgcaaaatcacgcacat

SEQ ID NO: 682548 - DNA, 25 bp, Rattus norvegicus
ttgggctatgcataatcacgcacat

SEQ ID NO: 682549 - DNA, 25 bp, Rattus norvegicus
ttgggctattggcacatgacggaca

SEQ ID NO: 682550 - DNA, 25 bp, Rattus norvegicus
ttgggctattgggacatgacggaca

SEQ ID NO: 682551 - DNA, 25 bp, Rattus norvegicus
ttgggctcagcaccacttgatggat

SEQ ID NO: 682552 - DNA, 25 bp, Rattus norvegicus
ttgggctcagcagcacttgatggat

SEQ ID NO: 682553 - DNA, 25 bp, Rattus norvegicus
ttgggctcagctagcgaatgacaca

SEQ ID NO: 682554 - DNA, 25 bp, Rattus norvegicus
ttgggctcagcttgcgaatgacaca

SEQ ID NO: 682555 - DNA, 25 bp, Rattus norvegicus
ttgggctcaggaacaacacgcatca

SEQ ID NO: 682556 - DNA, 25 bp, Rattus norvegicus
ttgggctcaggatcaacacgcatca

SEQ ID NO: 682557 - DNA, 25 bp, Rattus norvegicus
ttgggctcatatatagtgttttcta

SEQ ID NO: 682558 - DNA, 25 bp, Rattus norvegicus
ttgggctcatatttagtgttttcta

SEQ ID NO: 682559 - DNA, 25 bp, Rattus norvegicus
ttgggctccatgcactaccaggcat

SEQ ID NO: 682560 - DNA, 25 bp, Rattus norvegicus
ttgggctccatggactaccaggcat

SEQ ID NO: 682561 - DNA, 25 bp, Rattus norvegicus
ttgggctccattacctccctgaggg

SEQ ID NO: 682562 - DNA, 25 bp, Rattus norvegicus
ttgggctccatttcctccctgaggg

SEQ ID NO: 682563 - DNA, 25 bp, Rattus norvegicus
ttgggctccttcatggtgatggcac

SEQ ID NO: 682564 - DNA, 25 bp, Rattus norvegicus
ttgggctccttcttggtgatggcac

SEQ ID NO: 682565 - DNA, 25 bp, Rattus norvegicus
ttgggctctacaccgatcagatgcg

SEQ ID NO: 682566 - DNA, 25 bp, Rattus norvegicus
ttgggctctacagcgatcagatgcg

SEQ ID NO: 682567 - DNA, 25 bp, Rattus norvegicus
ttgggctctcagcttttgcttagat

SEQ ID NO: 682568 - DNA, 25 bp, Rattus norvegicus
ttgggctctcaggttttgcttagat

SEQ ID NO: 682569 - DNA, 25 bp, Rattus norvegicus
ttgggctctgtgagataacatgact

SEQ ID NO: 682570 - DNA, 25 bp, Rattus norvegicus
ttgggctctgtgtgataacatgact

SEQ ID NO: 682571 - DNA, 25 bp, Rattus norvegicus
ttgggctcttctatctattttgtaa

SEQ ID NO: 682572 - DNA, 25 bp, Rattus norvegicus
ttgggctcttctttctattttgtaa

SEQ ID NO: 682573 - DNA, 25 bp, Rattus norvegicus
ttgggctgagtaaaatgtaggttcc

SEQ ID NO: 682574 - DNA, 25 bp, Rattus norvegicus
ttgggctgagtataatgtaggttcc

SEQ ID NO: 682575 - DNA, 25 bp, Rattus norvegicus
ttgggctgccctatcaacaagtggg

SEQ ID NO: 682576 - DNA, 25 bp, Rattus norvegicus
ttgggctgccctttcaacaagtggg

SEQ ID NO: 682577 - DNA, 25 bp, Rattus norvegicus
ttgggctgcctgacacattttaccg

SEQ ID NO: 682578 - DNA, 25 bp, Rattus norvegicus
ttgggctgcctgtcacattttaccg

SEQ ID NO: 682579 - DNA, 25 bp, Rattus norvegicus
ttgggctgccttacctcaaatagaa

SEQ ID NO: 682580 - DNA, 25 bp, Rattus norvegicus
ttgggctgcctttcctcaaatagaa

SEQ ID NO: 682581 - DNA, 25 bp, Rattus norvegicus
ttgggctgctggagcaaaccactgg

SEQ ID NO: 682582 - DNA, 25 bp, Rattus norvegicus
ttgggctgctggtgcaaaccactgg

SEQ ID NO: 682583 - DNA, 25 bp, Rattus norvegicus
ttgggctggaatctgctgtctatag

SEQ ID NO: 682584 - DNA, 25 bp, Rattus norvegicus
ttgggctggaatgtgctgtctatag

SEQ ID NO: 682585 - DNA, 25 bp, Rattus norvegicus
ttgggctggctaaagtggctcactc

SEQ ID NO: 682586 - DNA, 25 bp, Rattus norvegicus
ttgggctggctatagtggctcactc

SEQ ID NO: 682587 - DNA, 25 bp, Rattus norvegicus
ttgggctgtcacaggattcctctgg

SEQ ID NO: 682588 - DNA, 25 bp, Rattus norvegicus
ttgggctgtcactggattcctctgg

SEQ ID NO: 682589 - DNA, 25 bp, Rattus norvegicus
ttgggctgtcagagttcacgcacca

SEQ ID NO: 682590 - DNA, 25 bp, Rattus norvegicus
ttgggctgtcagctggaacatgaaa

SEQ ID NO: 682591 - DNA, 25 bp, Rattus norvegicus
ttgggctgtcaggtggaacatgaaa

SEQ ID NO: 682592 - DNA, 25 bp, Rattus norvegicus
ttgggctgtcagtgttcacgcacca

SEQ ID NO: 682593 - DNA, 25 bp, Rattus norvegicus
ttgggctgtgccactaagtgagact

SEQ ID NO: 682594 - DNA, 25 bp, Rattus norvegicus
ttgggctgtgcctctaagtgagact

SEQ ID NO: 682595 - DNA, 25 bp, Rattus norvegicus
ttgggctgtgtgacatttgaagtgt

SEQ ID NO: 682596 - DNA, 25 bp, Rattus norvegicus
ttgggctgtgtgtcatttgaagtgt

SEQ ID NO: 682597 - DNA, 25 bp, Rattus norvegicus
ttgggcttaaatatgtctttcgaat

SEQ ID NO: 682598 - DNA, 25 bp, Rattus norvegicus
ttgggcttaaatttgtctttcgaat

SEQ ID NO: 682599 - DNA, 25 bp, Rattus norvegicus
ttgggcttgaaccaagacccttcac

SEQ ID NO: 682600 - DNA, 25 bp, Rattus norvegicus
ttgggcttgaacgaagacccttcac

SEQ ID NO: 682601 - DNA, 25 bp, Rattus norvegicus
ttgggctttatacagggtccctgcc

SEQ ID NO: 682602 - DNA, 25 bp, Rattus norvegicus
ttgggctttatagagggtccctgcc

SEQ ID NO: 682603 - DNA, 25 bp, Rattus norvegicus
ttgggctttgccaactaggttcatc

SEQ ID NO: 682604 - DNA, 25 bp, Rattus norvegicus
ttgggctttgcctactaggttcatc

SEQ ID NO: 682605 - DNA, 25 bp, Rattus norvegicus
ttgggctttgctaggagttctagat

SEQ ID NO: 682606 - DNA, 25 bp, Rattus norvegicus
ttgggctttgcttggagttctagat

SEQ ID NO: 682607 - DNA, 25 bp, Rattus norvegicus
ttgggctttgtcatttccctgaaat

SEQ ID NO: 682608 - DNA, 25 bp, Rattus norvegicus
ttgggctttgtcttttccctgaaat

SEQ ID NO: 682609 - DNA, 25 bp, Rattus norvegicus
ttggggggtccaacctggcctctct

SEQ ID NO: 682610 - DNA, 25 bp, Rattus norvegicus
ttggggggtccatcctggcctctct

SEQ ID NO: 682611 - DNA, 25 bp, Rattus norvegicus
ttgggtaaaactcctgaaactcagc

SEQ ID NO: 682612 - DNA, 25 bp, Rattus norvegicus
ttgggtaaaactgctgaaactcagc

SEQ ID NO: 682613 - DNA, 25 bp, Rattus norvegicus
ttgggtaactgaacacccacacact

SEQ ID NO: 682614 - DNA, 25 bp, Rattus norvegicus
ttgggtaactgatcacccacacact

SEQ ID NO: 682615 - DNA, 25 bp, Rattus norvegicus
ttgggtaagcatattccgtagtcag

SEQ ID NO: 682616 - DNA, 25 bp, Rattus norvegicus
ttgggtaagcattttccgtagtcag

SEQ ID NO: 682617 - DNA, 25 bp, Rattus norvegicus
ttgggtaagtccagggccttgcagt

SEQ ID NO: 682618 - DNA, 25 bp, Rattus norvegicus
ttgggtaagtcctgggccttgcagt

SEQ ID NO: 682619 - DNA, 25 bp, Rattus norvegicus
ttgggtacctaccatatgccaggcc

SEQ ID NO: 682620 - DNA, 25 bp, Rattus norvegicus
ttgggtacctacgatatgccaggcc

SEQ ID NO: 682621 - DNA, 25 bp, Rattus norvegicus
ttgggtacggaaaggcaggccttct

SEQ ID NO: 682622 - DNA, 25 bp, Rattus norvegicus
ttgggtacggaatggcaggccttct

SEQ ID NO: 682623 - DNA, 25 bp, Rattus norvegicus
ttgggtactggtactcacggtctac

SEQ ID NO: 682624 - DNA, 25 bp, Rattus norvegicus
ttgggtactggttctcacggtctac

SEQ ID NO: 682625 - DNA, 25 bp, Rattus norvegicus
ttgggtactgttactccattttaca

SEQ ID NO: 682626 - DNA, 25 bp, Rattus norvegicus
ttgggtactgtttctccattttaca

SEQ ID NO: 682627 - DNA, 25 bp, Rattus norvegicus
ttgggtacttcgatgacactatcct

SEQ ID NO: 682628 - DNA, 25 bp, Rattus norvegicus
ttgggtacttcgttgacactatcct

SEQ ID NO: 682629 - DNA, 25 bp, Rattus norvegicus
ttgggtacttctcgcctgtgaacaa

SEQ ID NO: 682630 - DNA, 25 bp, Rattus norvegicus
ttgggtacttctggcctgtgaacaa

SEQ ID NO: 682631 - DNA, 25 bp, Rattus norvegicus
ttgggtatccaacggtttagcctga

SEQ ID NO: 682632 - DNA, 25 bp, Rattus norvegicus
ttgggtatccaagggtttagcctga

SEQ ID NO: 682633 - DNA, 25 bp, Rattus norvegicus
ttgggtatgcctatgtccctgggta

SEQ ID NO: 682634 - DNA, 25 bp, Rattus norvegicus
ttgggtatgcctttgtccctgggta

SEQ ID NO: 682635 - DNA, 25 bp, Rattus norvegicus
ttgggtcaagacaccacgccattgt

SEQ ID NO: 682636 - DNA, 25 bp, Rattus norvegicus
ttgggtcaagactccacgccattgt

SEQ ID NO: 682637 - DNA, 25 bp, Rattus norvegicus
ttgggtcacagacactcttccatca

SEQ ID NO: 682638 - DNA, 25 bp, Rattus norvegicus
ttgggtcacagagactcttccatca

SEQ ID NO: 682639 - DNA, 25 bp, Rattus norvegicus
ttgggtcagggcactcacgtgaact

SEQ ID NO: 682640 - DNA, 25 bp, Rattus norvegicus
ttgggtcagggctctcacgtgaact

SEQ ID NO: 682641 - DNA, 25 bp, Rattus norvegicus
ttgggtcataatccttactcagtgt

SEQ ID NO: 682642 - DNA, 25 bp, Rattus norvegicus
ttgggtcataatgcttactcagtgt

SEQ ID NO: 682643 - DNA, 25 bp, Rattus norvegicus
ttgggtcatctgctttttcatttct

SEQ ID NO: 682644 - DNA, 25 bp, Rattus norvegicus
ttgggtcatctggtttttcatttct

SEQ ID NO: 682645 - DNA, 25 bp, Rattus norvegicus
ttgggtcatttcatcatcaggatat

SEQ ID NO: 682646 - DNA, 25 bp, Rattus norvegicus
ttgggtcatttcttcatcaggatat

SEQ ID NO: 682647 - DNA, 25 bp, Rattus norvegicus
ttgggtccaacaaacccgcgtgtga

SEQ ID NO: 682648 - DNA, 25 bp, Rattus norvegicus
ttgggtccaacatacccgcgtgtga

SEQ ID NO: 682649 - DNA, 25 bp, Rattus norvegicus
ttgggtccagctacatcactgacag

SEQ ID NO: 682650 - DNA, 25 bp, Rattus norvegicus
ttgggtccagcttcatcactgacag

SEQ ID NO: 682651 - DNA, 25 bp, Rattus norvegicus
ttgggtccatcccagtgatgcatga

SEQ ID NO: 682652 - DNA, 25 bp, Rattus norvegicus
ttgggtccatccgagtgatgcatga

SEQ ID NO: 682653 - DNA, 25 bp, Rattus norvegicus
ttgggtccatcgcactgccctggga

SEQ ID NO: 682654 - DNA, 25 bp, Rattus norvegicus
ttgggtccatcggactgccctggga

SEQ ID NO: 682655 - DNA, 25 bp, Rattus norvegicus
ttgggtcccaaaaacctgaatgcac

SEQ ID NO: 682656 - DNA, 25 bp, Rattus norvegicus
ttgggtcccaaacagctgccactgg

SEQ ID NO: 682657 - DNA, 25 bp, Rattus norvegicus
ttgggtcccaaagagctgccactgg

SEQ ID NO: 682658 - DNA, 25 bp, Rattus norvegicus
ttgggtcccaaatacctgaatgcac

SEQ ID NO: 682659 - DNA, 25 bp, Rattus norvegicus
ttgggtcccaagctggctgtgcttt

SEQ ID NO: 682660 - DNA, 25 bp, Rattus norvegicus
ttgggtcccaaggtggctgtgcttt

SEQ ID NO: 682661 - DNA, 25 bp, Rattus norvegicus
ttgggtcccatcacacgacaaggtg

SEQ ID NO: 682662 - DNA, 25 bp, Rattus norvegicus
ttgggtcccatctcacgacaaggtg

SEQ ID NO: 682663 - DNA, 25 bp, Rattus norvegicus
ttgggtccccacaaaggcaaccaga

SEQ ID NO: 682664 - DNA, 25 bp, Rattus norvegicus
ttgggtccccactaaggcaaccaga

SEQ ID NO: 682665 - DNA, 25 bp, Rattus norvegicus
ttgggtcccgaacagttcaaagcct

SEQ ID NO: 682666 - DNA, 25 bp, Rattus norvegicus
ttgggtcccgaagagttcaaagcct

SEQ ID NO: 682667 - DNA, 25 bp, Rattus norvegicus
ttgggtcccgctcctaaaggtaaag

SEQ ID NO: 682668 - DNA, 25 bp, Rattus norvegicus
ttgggtcccgctgctaaaggtaaag

SEQ ID NO: 682669 - DNA, 25 bp, Rattus norvegicus
ttgggtcccgttacatattgcacat

SEQ ID NO: 682670 - DNA, 25 bp, Rattus norvegicus
ttgggtcccgtttcatattgcacat

SEQ ID NO: 682671 - DNA, 25 bp, Rattus norvegicus
ttgggtcctgacacttccaggcaaa

SEQ ID NO: 682672 - DNA, 25 bp, Rattus norvegicus
ttgggtcctgactcttccaggcaaa

SEQ ID NO: 682673 - DNA, 25 bp, Rattus norvegicus
ttgggtctagcaatggccttcaaag

SEQ ID NO: 682674 - DNA, 25 bp, Rattus norvegicus
ttgggtctagcattggccttcaaag

SEQ ID NO: 682675 - DNA, 25 bp, Rattus norvegicus
ttgggtctagttatgccagcagtca

SEQ ID NO: 682676 - DNA, 25 bp, Rattus norvegicus
ttgggtctagttttgccagcagtca

SEQ ID NO: 682677 - DNA, 25 bp, Rattus norvegicus
ttgggtctcacacagcggcaggtaa

SEQ ID NO: 682678 - DNA, 25 bp, Rattus norvegicus
ttgggtctcacagagcggcaggtaa

SEQ ID NO: 682679 - DNA, 25 bp, Rattus norvegicus
ttgggtctccagcacaaatctgtat

SEQ ID NO: 682680 - DNA, 25 bp, Rattus norvegicus
ttgggtctccaggacaaatctgtat

SEQ ID NO: 682681 - DNA, 25 bp, Rattus norvegicus
ttgggtctccatcgagatgggcaca

SEQ ID NO: 682682 - DNA, 25 bp, Rattus norvegicus
ttgggtctccatctgggcttcttca

SEQ ID NO: 682683 - DNA, 25 bp, Rattus norvegicus
ttgggtctccatggagatgggcaca

SEQ ID NO: 682684 - DNA, 25 bp, Rattus norvegicus
ttgggtctccatgtgggcttcttca

SEQ ID NO: 682685 - DNA, 25 bp, Rattus norvegicus
ttgggtctccttaatattttcttag

SEQ ID NO: 682686 - DNA, 25 bp, Rattus norvegicus
ttgggtctcctttatattttcttag

SEQ ID NO: 682687 - DNA, 25 bp, Rattus norvegicus
ttgggtctctacactggtcagctgg

SEQ ID NO: 682688 - DNA, 25 bp, Rattus norvegicus
ttgggtctctactctggtcagctgg

SEQ ID NO: 682689 - DNA, 25 bp, Rattus norvegicus
ttgggtctctttcatttcttgctag

SEQ ID NO: 682690 - DNA, 25 bp, Rattus norvegicus
ttgggtctctttgatttcttgctag

SEQ ID NO: 682691 - DNA, 25 bp, Rattus norvegicus
ttgggtctgaggatcaaacccctga

SEQ ID NO: 682692 - DNA, 25 bp, Rattus norvegicus
ttgggtctgaggttcaaacccctga

SEQ ID NO: 682693 - DNA, 25 bp, Rattus norvegicus
ttgggtctgattacatgcacttctc

SEQ ID NO: 682694 - DNA, 25 bp, Rattus norvegicus
ttgggtctgatttcatgcacttctc

SEQ ID NO: 682695 - DNA, 25 bp, Rattus norvegicus
ttgggtctgcttcctgctttcaaag

SEQ ID NO: 682696 - DNA, 25 bp, Rattus norvegicus
ttgggtctgcttgctgctttcaaag

SEQ ID NO: 682697 - DNA, 25 bp, Rattus norvegicus
ttgggtctgttactgtgctgagcac

SEQ ID NO: 682698 - DNA, 25 bp, Rattus norvegicus
ttgggtctgttagtgtgctgagcac

SEQ ID NO: 682699 - DNA, 25 bp, Rattus norvegicus
ttgggtcttccgaggccaagatctt

SEQ ID NO: 682700 - DNA, 25 bp, Rattus norvegicus
ttgggtcttccgtggccaagatctt

SEQ ID NO: 682701 - DNA, 25 bp, Rattus norvegicus
ttgggtcttgacacttaatgcatgt

SEQ ID NO: 682702 - DNA, 25 bp, Rattus norvegicus
ttgggtcttgactcttaatgcatgt

SEQ ID NO: 682703 - DNA, 25 bp, Rattus norvegicus
ttgggtcttgccacataagtatgta

SEQ ID NO: 682704 - DNA, 25 bp, Rattus norvegicus
ttgggtcttgcctcataagtatgta

SEQ ID NO: 682705 - DNA, 25 bp, Rattus norvegicus
ttgggtcttggcacttgttagtata

SEQ ID NO: 682706 - DNA, 25 bp, Rattus norvegicus
ttgggtcttggctcttgttagtata

SEQ ID NO: 682707 - DNA, 25 bp, Rattus norvegicus
ttgggtctttgtacattttgcttga

SEQ ID NO: 682708 - DNA, 25 bp, Rattus norvegicus
ttgggtctttgttcattttgcttga

SEQ ID NO: 682709 - DNA, 25 bp, Rattus norvegicus
ttgggtgacccaccgagtttggacc

SEQ ID NO: 682710 - DNA, 25 bp, Rattus norvegicus
ttgggtgacccagcgagtttggacc

SEQ ID NO: 682711 - DNA, 25 bp, Rattus norvegicus
ttgggtgactcaaaccttaaggact

SEQ ID NO: 682712 - DNA, 25 bp, Rattus norvegicus
ttgggtgactcataccttaaggact

SEQ ID NO: 682713 - DNA, 25 bp, Rattus norvegicus
ttgggtgactcgacctagcagagac

SEQ ID NO: 682714 - DNA, 25 bp, Rattus norvegicus
ttgggtgactcgtcctagcagagac

SEQ ID NO: 682715 - DNA, 25 bp, Rattus norvegicus
ttgggtgattcgcaactgcctgtaa

SEQ ID NO: 682716 - DNA, 25 bp, Rattus norvegicus
ttgggtgattcggaactgcctgtaa

SEQ ID NO: 682717 - DNA, 25 bp, Rattus norvegicus
ttgggtgcaacaactgtggcagcca

SEQ ID NO: 682718 - DNA, 25 bp, Rattus norvegicus
ttgggtgcaacatctgtggcagcca

SEQ ID NO: 682719 - DNA, 25 bp, Rattus norvegicus
ttgggtgcagagaccagtattttct

SEQ ID NO: 682720 - DNA, 25 bp, Rattus norvegicus
ttgggtgcagagtccagtattttct

SEQ ID NO: 682721 - DNA, 25 bp, Rattus norvegicus
ttgggtgcaggcagtgccaccatcc

SEQ ID NO: 682722 - DNA, 25 bp, Rattus norvegicus
ttgggtgcaggctgtgccaccatcc

SEQ ID NO: 682723 - DNA, 25 bp, Rattus norvegicus
ttgggtgccaaccttccatatttgg

SEQ ID NO: 682724 - DNA, 25 bp, Rattus norvegicus
ttgggtgccaacgttccatatttgg

SEQ ID NO: 682725 - DNA, 25 bp, Rattus norvegicus
ttgggtgccaatctccagtacatga

SEQ ID NO: 682726 - DNA, 25 bp, Rattus norvegicus
ttgggtgccaatgtccagtacatga

SEQ ID NO: 682727 - DNA, 25 bp, Rattus norvegicus
ttgggtgccagacaagttccacatc

SEQ ID NO: 682728 - DNA, 25 bp, Rattus norvegicus
ttgggtgccagagaagttccacatc

SEQ ID NO: 682729 - DNA, 25 bp, Rattus norvegicus
ttgggtgccatcaccggcattgctt

SEQ ID NO: 682730 - DNA, 25 bp, Rattus norvegicus
ttgggtgccatctccggcattgctt

SEQ ID NO: 682731 - DNA, 25 bp, Rattus norvegicus
ttgggtgctctgaaatgtgtcctca

SEQ ID NO: 682732 - DNA, 25 bp, Rattus norvegicus
ttgggtgctctgtaatgtgtcctca

SEQ ID NO: 682733 - DNA, 25 bp, Rattus norvegicus
ttgggtgctgcgaacttctccaggg

SEQ ID NO: 682734 - DNA, 25 bp, Rattus norvegicus
ttgggtgctgcgtacttctccaggg

SEQ ID NO: 682735 - DNA, 25 bp, Rattus norvegicus
ttgggtggagccattccctggaaag

SEQ ID NO: 682736 - DNA, 25 bp, Rattus norvegicus
ttgggtggagcctttccctggaaag

SEQ ID NO: 682737 - DNA, 25 bp, Rattus norvegicus
ttgggtggccaacgacatcccggat

SEQ ID NO: 682738 - DNA, 25 bp, Rattus norvegicus
ttgggtggccaacgactctcagtaa

SEQ ID NO: 682739 - DNA, 25 bp, Rattus norvegicus
ttgggtggccaaggacatcccggat

SEQ ID NO: 682740 - DNA, 25 bp, Rattus norvegicus
ttgggtggccaaggactctcagtaa

SEQ ID NO: 682741 - DNA, 25 bp, Rattus norvegicus
ttgggtggccgcagggctcaccatt

SEQ ID NO: 682742 - DNA, 25 bp, Rattus norvegicus
ttgggtggccgctgggctcaccatt

SEQ ID NO: 682743 - DNA, 25 bp, Rattus norvegicus
ttgggtgtaatgatgccccttgacc

SEQ ID NO: 682744 - DNA, 25 bp, Rattus norvegicus
ttgggtgtaatgctcctttttgatt

SEQ ID NO: 682745 - DNA, 25 bp, Rattus norvegicus
ttgggtgtaatggtcctttttgatt

SEQ ID NO: 682746 - DNA, 25 bp, Rattus norvegicus
ttgggtgtaatgttgccccttgacc

SEQ ID NO: 682747 - DNA, 25 bp, Rattus norvegicus
ttgggtgtagccatctttgcataag

SEQ ID NO: 682748 - DNA, 25 bp, Rattus norvegicus
ttgggtgtagccttctttgcataag

SEQ ID NO: 682749 - DNA, 25 bp, Rattus norvegicus
ttgggtgtaggcagtctcactgcat

SEQ ID NO: 682750 - DNA, 25 bp, Rattus norvegicus
ttgggtgtaggctgtctcactgcat

SEQ ID NO: 682751 - DNA, 25 bp, Rattus norvegicus
ttgggtgtcacaattctttggtttg

SEQ ID NO: 682752 - DNA, 25 bp, Rattus norvegicus
ttgggtgtcacatttctttggtttg

SEQ ID NO: 682753 - DNA, 25 bp, Rattus norvegicus
ttgggtgtcaccagtccgttcccca

SEQ ID NO: 682754 - DNA, 25 bp, Rattus norvegicus
ttgggtgtcacctgtccgttcccca

SEQ ID NO: 682755 - DNA, 25 bp, Rattus norvegicus
ttgggtgtcctcacagttctataac

SEQ ID NO: 682756 - DNA, 25 bp, Rattus norvegicus
ttgggtgtcctctcagttctataac

SEQ ID NO: 682757 - DNA, 25 bp, Rattus norvegicus
ttgggtgtctaactctcaggatgca

SEQ ID NO: 682758 - DNA, 25 bp, Rattus norvegicus
ttgggtgtctaagtctcaggatgca

SEQ ID NO: 682759 - DNA, 25 bp, Rattus norvegicus
ttgggtgtctaccttttctgtagtt

SEQ ID NO: 682760 - DNA, 25 bp, Rattus norvegicus
ttgggtgtctacgttttctgtagtt

SEQ ID NO: 682761 - DNA, 25 bp, Rattus norvegicus
ttgggtgttcctcatcacatgtata

SEQ ID NO: 682762 - DNA, 25 bp, Rattus norvegicus
ttgggtgttcctgatcacatgtata

SEQ ID NO: 682763 - DNA, 25 bp, Rattus norvegicus
ttgggttacacgaacagctgcctga

SEQ ID NO: 682764 - DNA, 25 bp, Rattus norvegicus
ttgggttacacgtacagctgcctga

SEQ ID NO: 682765 - DNA, 25 bp, Rattus norvegicus
ttgggttactggctgtgctatgtca

SEQ ID NO: 682766 - DNA, 25 bp, Rattus norvegicus
ttgggttactgggtgtgctatgtca

SEQ ID NO: 682767 - DNA, 25 bp, Rattus norvegicus
ttgggttcaagcctactgcagtgtc

SEQ ID NO: 682768 - DNA, 25 bp, Rattus norvegicus
ttgggttcaagcgtactgcagtgtc

SEQ ID NO: 682769 - DNA, 25 bp, Rattus norvegicus
ttgggttcactccagcattgataaa

SEQ ID NO: 682770 - DNA, 25 bp, Rattus norvegicus
ttgggttcactcgagcattgataaa

SEQ ID NO: 682771 - DNA, 25 bp, Rattus norvegicus
ttgggttcatagacgccatctgctt

SEQ ID NO: 682772 - DNA, 25 bp, Rattus norvegicus
ttgggttcatagtcgccatctgctt

SEQ ID NO: 682773 - DNA, 25 bp, Rattus norvegicus
ttgggttccactagggttccacctg

SEQ ID NO: 682774 - DNA, 25 bp, Rattus norvegicus
ttgggttccacttgggttccacctg

SEQ ID NO: 682775 - DNA, 25 bp, Rattus norvegicus
ttgggttccattatgtacgagtttg

SEQ ID NO: 682776 - DNA, 25 bp, Rattus norvegicus
ttgggttccattttgtacgagtttg

SEQ ID NO: 682777 - DNA, 25 bp, Rattus norvegicus
ttgggttccccacagggccttagag

SEQ ID NO: 682778 - DNA, 25 bp, Rattus norvegicus
ttgggttccccagagggccttagag

SEQ ID NO: 682779 - DNA, 25 bp, Rattus norvegicus
ttgggttccctcagaggctgggcca

SEQ ID NO: 682780 - DNA, 25 bp, Rattus norvegicus
ttgggttccctcctagaaaggactg

SEQ ID NO: 682781 - DNA, 25 bp, Rattus norvegicus
ttgggttccctcgtagaaaggactg

SEQ ID NO: 682782 - DNA, 25 bp, Rattus norvegicus
ttgggttccctctgaggctgggcca

SEQ ID NO: 682783 - DNA, 25 bp, Rattus norvegicus
ttgggttcccttccgaatttgcaca

SEQ ID NO: 682784 - DNA, 25 bp, Rattus norvegicus
ttgggttcccttgcgaatttgcaca

SEQ ID NO: 682785 - DNA, 25 bp, Rattus norvegicus
ttgggttccgaaccgttcccatttg

SEQ ID NO: 682786 - DNA, 25 bp, Rattus norvegicus
ttgggttccgaagcgttcccatttg

SEQ ID NO: 682787 - DNA, 25 bp, Rattus norvegicus
ttgggttcctcacgccaggcaagcc

SEQ ID NO: 682788 - DNA, 25 bp, Rattus norvegicus
ttgggttcctcaggccaggcaagcc

SEQ ID NO: 682789 - DNA, 25 bp, Rattus norvegicus
ttgggttcgccaagcagcctttcag

SEQ ID NO: 682790 - DNA, 25 bp, Rattus norvegicus
ttgggttcgccatgcagcctttcag

SEQ ID NO: 682791 - DNA, 25 bp, Rattus norvegicus
ttgggttctacccaccactgtgtca

SEQ ID NO: 682792 - DNA, 25 bp, Rattus norvegicus
ttgggttctaccgaccactgtgtca

SEQ ID NO: 682793 - DNA, 25 bp, Rattus norvegicus
ttgggttctcataggatgcttcctg

SEQ ID NO: 682794 - DNA, 25 bp, Rattus norvegicus
ttgggttctcattggatgcttcctg

SEQ ID NO: 682795 - DNA, 25 bp, Rattus norvegicus
ttgggttctctgagtctatcatcac

SEQ ID NO: 682796 - DNA, 25 bp, Rattus norvegicus
ttgggttctctgtgtctatcatcac

SEQ ID NO: 682797 - DNA, 25 bp, Rattus norvegicus
ttgggttctcttcagccaagacttc

SEQ ID NO: 682798 - DNA, 25 bp, Rattus norvegicus
ttgggttctcttgagccaagacttc

SEQ ID NO: 682799 - DNA, 25 bp, Rattus norvegicus
ttgggttctgtactgctatagttgt

SEQ ID NO: 682800 - DNA, 25 bp, Rattus norvegicus
ttgggttctgtagtgctatagttgt

SEQ ID NO: 682801 - DNA, 25 bp, Rattus norvegicus
ttgggttctgtcactaagcacctca

SEQ ID NO: 682802 - DNA, 25 bp, Rattus norvegicus
ttgggttctgtctctaagcacctca

SEQ ID NO: 682803 - DNA, 25 bp, Rattus norvegicus
ttgggttcttcgctcacagctctgc

SEQ ID NO: 682804 - DNA, 25 bp, Rattus norvegicus
ttgggttcttcggtcacagctctgc

SEQ ID NO: 682805 - DNA, 25 bp, Rattus norvegicus
ttgggttcttctaaatcatgttgga

SEQ ID NO: 682806 - DNA, 25 bp, Rattus norvegicus
ttgggttcttcttaatcatgttgga

SEQ ID NO: 682807 - DNA, 25 bp, Rattus norvegicus
ttgggttctttaaactctcaggctg

SEQ ID NO: 682808 - DNA, 25 bp, Rattus norvegicus
ttgggttctttatactctcaggctg

SEQ ID NO: 682809 - DNA, 25 bp, Rattus norvegicus
ttgggttgcttcaaggcccatggaa

SEQ ID NO: 682810 - DNA, 25 bp, Rattus norvegicus
ttgggttgcttctaggcccatggaa

SEQ ID NO: 682811 - DNA, 25 bp, Rattus norvegicus
ttgggttgctttcatttgccatctc

SEQ ID NO: 682812 - DNA, 25 bp, Rattus norvegicus
ttgggttgctttgatttgccatctc

SEQ ID NO: 682813 - DNA, 25 bp, Rattus norvegicus
ttgggttggcacatgtcccttctga

SEQ ID NO: 682814 - DNA, 25 bp, Rattus norvegicus
ttgggttggcacttgtcccttctga

SEQ ID NO: 682815 - DNA, 25 bp, Rattus norvegicus
ttgggttggtacagcttccgtcccg

SEQ ID NO: 682816 - DNA, 25 bp, Rattus norvegicus
ttgggttggtactgcttccgtcccg

SEQ ID NO: 682817 - DNA, 25 bp, Rattus norvegicus
ttgggttggttcatagtgctacttc

SEQ ID NO: 682818 - DNA, 25 bp, Rattus norvegicus
ttgggttggttcttagtgctacttc

SEQ ID NO: 682819 - DNA, 25 bp, Rattus norvegicus
ttgggttgtactatctaagaaggtg

SEQ ID NO: 682820 - DNA, 25 bp, Rattus norvegicus
ttgggttgtactttctaagaaggtg

SEQ ID NO: 682821 - DNA, 25 bp, Rattus norvegicus
ttgggttgtgctcctgcgtctgtac

SEQ ID NO: 682822 - DNA, 25 bp, Rattus norvegicus
ttgggttgtgctgctgcgtctgtac

SEQ ID NO: 682823 - DNA, 25 bp, Rattus norvegicus
ttgggtttagttagctcctctgcaa

SEQ ID NO: 682824 - DNA, 25 bp, Rattus norvegicus
ttgggtttagtttgctcctctgcaa

SEQ ID NO: 682825 - DNA, 25 bp, Rattus norvegicus
ttgggtttcatactaactgtgttac

SEQ ID NO: 682826 - DNA, 25 bp, Rattus norvegicus
ttgggtttcatagtaactgtgttac

SEQ ID NO: 682827 - DNA, 25 bp, Rattus norvegicus
ttgggtttccaactgcagaaaacta

SEQ ID NO: 682828 - DNA, 25 bp, Rattus norvegicus
ttgggtttccaagtgcagaaaacta

SEQ ID NO: 682829 - DNA, 25 bp, Rattus norvegicus
ttgggtttccctcgcacatttcaca

SEQ ID NO: 682830 - DNA, 25 bp, Rattus norvegicus
ttgggtttccctggcacatttcaca

SEQ ID NO: 682831 - DNA, 25 bp, Rattus norvegicus
ttgggtttcctcatcttcagaatgg

SEQ ID NO: 682832 - DNA, 25 bp, Rattus norvegicus
ttgggtttcctcttcttcagaatgg

SEQ ID NO: 682833 - DNA, 25 bp, Rattus norvegicus
ttgggtttccttcacaatgccacat

SEQ ID NO: 682834 - DNA, 25 bp, Rattus norvegicus
ttgggtttccttgacaatgccacat

SEQ ID NO: 682835 - DNA, 25 bp, Rattus norvegicus
ttgggtttcgatcagatccggcaac

SEQ ID NO: 682836 - DNA, 25 bp, Rattus norvegicus
ttgggtttcgatgagatccggcaac

SEQ ID NO: 682837 - DNA, 25 bp, Rattus norvegicus
ttgggtttcgcaaggtctctactac

SEQ ID NO: 682838 - DNA, 25 bp, Rattus norvegicus
ttgggtttcgcatggtctctactac

SEQ ID NO: 682839 - DNA, 25 bp, Rattus norvegicus
ttgggtttctatagcacctgctgtc

SEQ ID NO: 682840 - DNA, 25 bp, Rattus norvegicus
ttgggtttctattgcacctgctgtc

SEQ ID NO: 682841 - DNA, 25 bp, Rattus norvegicus
ttgggtttgattccactacattaaa

SEQ ID NO: 682842 - DNA, 25 bp, Rattus norvegicus
ttgggtttgattgcactacattaaa

SEQ ID NO: 682843 - DNA, 25 bp, Rattus norvegicus
ttgggtttgctaccagtatcctgga

SEQ ID NO: 682844 - DNA, 25 bp, Rattus norvegicus
ttgggtttgctagcagtatcctgga

SEQ ID NO: 682845 - DNA, 25 bp, Rattus norvegicus
ttgggtttgggaccccattctcaac

SEQ ID NO: 682846 - DNA, 25 bp, Rattus norvegicus
ttgggtttgggagcccattctcaac

SEQ ID NO: 682847 - DNA, 25 bp, Rattus norvegicus
ttgggtttggtcctggcatcacaac

SEQ ID NO: 682848 - DNA, 25 bp, Rattus norvegicus
ttgggtttggtcgtggcatcacaac

SEQ ID NO: 682849 - DNA, 25 bp, Rattus norvegicus
ttgggttttagaactccagcaccat

SEQ ID NO: 682850 - DNA, 25 bp, Rattus norvegicus
ttgggttttagatctccagcaccat

SEQ ID NO: 682851 - DNA, 25 bp, Rattus norvegicus
ttgggttttcctagagtactggagt

SEQ ID NO: 682852 - DNA, 25 bp, Rattus norvegicus
ttgggttttccttgagtactggagt

SEQ ID NO: 682853 - DNA, 25 bp, Rattus norvegicus
ttgggttttcttagaggcagggtct

SEQ ID NO: 682854 - DNA, 25 bp, Rattus norvegicus
ttgggttttctttgaggcagggtct

SEQ ID NO: 682855 - DNA, 25 bp, Rattus norvegicus
ttgggttttgtgactgactttgcct

SEQ ID NO: 682856 - DNA, 25 bp, Rattus norvegicus
ttgggttttgtgtctgactttgcct

SEQ ID NO: 682857 - DNA, 25 bp, Rattus norvegicus
ttggtaaaagccacggcaacctgct

SEQ ID NO: 682858 - DNA, 25 bp, Rattus norvegicus
ttggtaaaagcctcggcaacctgct

SEQ ID NO: 682859 - DNA, 25 bp, Rattus norvegicus
ttggtaaacttccttccttgtgagt

SEQ ID NO: 682860 - DNA, 25 bp, Rattus norvegicus
ttggtaaacttcgttccttgtgagt

SEQ ID NO: 682861 - DNA, 25 bp, Rattus norvegicus
ttggtaaagccaagctggtccgccc

SEQ ID NO: 682862 - DNA, 25 bp, Rattus norvegicus
ttggtaaagccatgctggtccgccc

SEQ ID NO: 682863 - DNA, 25 bp, Rattus norvegicus
ttggtaacagccattcttcatggaa

SEQ ID NO: 682864 - DNA, 25 bp, Rattus norvegicus
ttggtaacagcctttcttcatggaa

SEQ ID NO: 682865 - DNA, 25 bp, Rattus norvegicus
ttggtaactgaactagagacacatt

SEQ ID NO: 682866 - DNA, 25 bp, Rattus norvegicus
ttggtaactgaagtagagacacatt

SEQ ID NO: 682867 - DNA, 25 bp, Rattus norvegicus
ttggtaatccaccaccaagcctggg

SEQ ID NO: 682868 - DNA, 25 bp, Rattus norvegicus
ttggtaatccacgaccaagcctggg

SEQ ID NO: 682869 - DNA, 25 bp, Rattus norvegicus
ttggtaatccttctgttgtggcctc

SEQ ID NO: 682870 - DNA, 25 bp, Rattus norvegicus
ttggtaatccttgtgttgtggcctc

SEQ ID NO: 682871 - DNA, 25 bp, Rattus norvegicus
ttggtaatgagccccggattacgcg

SEQ ID NO: 682872 - DNA, 25 bp, Rattus norvegicus
ttggtaatgagcgccggattacgcg

SEQ ID NO: 682873 - DNA, 25 bp, Rattus norvegicus
ttggtaatgatcctttaatattggg

SEQ ID NO: 682874 - DNA, 25 bp, Rattus norvegicus
ttggtaatgatcgtttaatattggg

SEQ ID NO: 682875 - DNA, 25 bp, Rattus norvegicus
ttggtaatgccaaacagctatgtta

SEQ ID NO: 682876 - DNA, 25 bp, Rattus norvegicus
ttggtaatgccatacagctatgtta

SEQ ID NO: 682877 - DNA, 25 bp, Rattus norvegicus
ttggtacatattatctcccatcacc

SEQ ID NO: 682878 - DNA, 25 bp, Rattus norvegicus
ttggtacatattttctcccatcacc

SEQ ID NO: 682879 - DNA, 25 bp, Rattus norvegicus
ttggtacatttcaagcttgctactt

SEQ ID NO: 682880 - DNA, 25 bp, Rattus norvegicus
ttggtacatttctagcttgctactt

SEQ ID NO: 682881 - DNA, 25 bp, Rattus norvegicus
ttggtacccctaaccacagcgtttg

SEQ ID NO: 682882 - DNA, 25 bp, Rattus norvegicus
ttggtacccctatccacagcgtttg

SEQ ID NO: 682883 - DNA, 25 bp, Rattus norvegicus
ttggtaccctcgctgtcattcctga

SEQ ID NO: 682884 - DNA, 25 bp, Rattus norvegicus
ttggtaccctcggtgtcattcctga

SEQ ID NO: 682885 - DNA, 25 bp, Rattus norvegicus
ttggtaccgattatgggactgtaag

SEQ ID NO: 682886 - DNA, 25 bp, Rattus norvegicus
ttggtaccgattttgggactgtaag

SEQ ID NO: 682887 - DNA, 25 bp, Rattus norvegicus
ttggtaccgcctcttaacaagcttt

SEQ ID NO: 682888 - DNA, 25 bp, Rattus norvegicus
ttggtaccgcctgttaacaagcttt

SEQ ID NO: 682889 - DNA, 25 bp, Rattus norvegicus
ttggtaccgtatcaagctctttccc

SEQ ID NO: 682890 - DNA, 25 bp, Rattus norvegicus
ttggtaccgtatgaagctctttccc

SEQ ID NO: 682891 - DNA, 25 bp, Rattus norvegicus
ttggtacctacaactggcagatgat

SEQ ID NO: 682892 - DNA, 25 bp, Rattus norvegicus
ttggtacctacatctggcagatgat

SEQ ID NO: 682893 - DNA, 25 bp, Rattus norvegicus
ttggtacctagtccctctgggtcct

SEQ ID NO: 682894 - DNA, 25 bp, Rattus norvegicus
ttggtacctagtgcctctgggtcct

SEQ ID NO: 682895 - DNA, 25 bp, Rattus norvegicus
ttggtacctggaaactgccacagaa

SEQ ID NO: 682896 - DNA, 25 bp, Rattus norvegicus
ttggtacctggatactgccacagaa

SEQ ID NO: 682897 - DNA, 25 bp, Rattus norvegicus
ttggtaccttacctatggcagctgg

SEQ ID NO: 682898 - DNA, 25 bp, Rattus norvegicus
ttggtaccttacgtatggcagctgg

SEQ ID NO: 682899 - DNA, 25 bp, Rattus norvegicus
ttggtacgaaaacaactcagagccc

SEQ ID NO: 682900 - DNA, 25 bp, Rattus norvegicus
ttggtacgaaaagaactcagagccc

SEQ ID NO: 682901 - DNA, 25 bp, Rattus norvegicus
ttggtactaaacactagtcctgcct

SEQ ID NO: 682902 - DNA, 25 bp, Rattus norvegicus
ttggtactaaactctagtcctgcct

SEQ ID NO: 682903 - DNA, 25 bp, Rattus norvegicus
ttggtactgaaacccttctccctat

SEQ ID NO: 682904 - DNA, 25 bp, Rattus norvegicus
ttggtactgaaagccttctccctat

SEQ ID NO: 682905 - DNA, 25 bp, Rattus norvegicus
ttggtacttcacacttgctggtgac

SEQ ID NO: 682906 - DNA, 25 bp, Rattus norvegicus
ttggtacttcactcttgctggtgac

SEQ ID NO: 682907 - DNA, 25 bp, Rattus norvegicus
ttggtacttgctcccacacacaaaa

SEQ ID NO: 682908 - DNA, 25 bp, Rattus norvegicus
ttggtacttgctgccacacacaaaa

SEQ ID NO: 682909 - DNA, 25 bp, Rattus norvegicus
ttggtacttggaaccgacgttacag

SEQ ID NO: 682910 - DNA, 25 bp, Rattus norvegicus
ttggtacttggatccgacgttacag

SEQ ID NO: 682911 - DNA, 25 bp, Rattus norvegicus
ttggtagccatgctgatcagtgcct

SEQ ID NO: 682912 - DNA, 25 bp, Rattus norvegicus
ttggtagccatggtgatcagtgcct

SEQ ID NO: 682913 - DNA, 25 bp, Rattus norvegicus
ttggtagcctttcctgaggcctgaa

SEQ ID NO: 682914 - DNA, 25 bp, Rattus norvegicus
ttggtagcctttgctgaggcctgaa

SEQ ID NO: 682915 - DNA, 25 bp, Rattus norvegicus
ttggtaggcaaaagctctcccattc

SEQ ID NO: 682916 - DNA, 25 bp, Rattus norvegicus
ttggtaggcaaatgctctcccattc

SEQ ID NO: 682917 - DNA, 25 bp, Rattus norvegicus
ttggtaggctctcctgctataatca

SEQ ID NO: 682918 - DNA, 25 bp, Rattus norvegicus
ttggtaggctctgctgctataatca

SEQ ID NO: 682919 - DNA, 25 bp, Rattus norvegicus
ttggtagtcccaccagaggaactaa

SEQ ID NO: 682920 - DNA, 25 bp, Rattus norvegicus
ttggtagtcccagcagaggaactaa

SEQ ID NO: 682921 - DNA, 25 bp, Rattus norvegicus
ttggtagtcgaaagctccaggccat

SEQ ID NO: 682922 - DNA, 25 bp, Rattus norvegicus
ttggtagtcgaatgctccaggccat

SEQ ID NO: 682923 - DNA, 25 bp, Rattus norvegicus
ttggtagttttaagccttctctctc

SEQ ID NO: 682924 - DNA, 25 bp, Rattus norvegicus
ttggtagttttatgccttctctctc

SEQ ID NO: 682925 - DNA, 25 bp, Rattus norvegicus
ttggtagttttcagttcctgggcaa

SEQ ID NO: 682926 - DNA, 25 bp, Rattus norvegicus
ttggtagttttctgttcctgggcaa

SEQ ID NO: 682927 - DNA, 25 bp, Rattus norvegicus
ttggtatatcttaatgcggctgcat

SEQ ID NO: 682928 - DNA, 25 bp, Rattus norvegicus
ttggtatatctttatgcggctgcat

SEQ ID NO: 682929 - DNA, 25 bp, Rattus norvegicus
ttggtatattctaaggctgtctggg

SEQ ID NO: 682930 - DNA, 25 bp, Rattus norvegicus
ttggtatattcttaggctgtctggg

SEQ ID NO: 682931 - DNA, 25 bp, Rattus norvegicus
ttggtatcatccagccttttttatt

SEQ ID NO: 682932 - DNA, 25 bp, Rattus norvegicus
ttggtatcatcctgccttttttatt

SEQ ID NO: 682933 - DNA, 25 bp, Rattus norvegicus
ttggtatccaggactttatgccgtc

SEQ ID NO: 682934 - DNA, 25 bp, Rattus norvegicus
ttggtatccaggtctttatgccgtc

SEQ ID NO: 682935 - DNA, 25 bp, Rattus norvegicus
ttggtatcccaaatcactcgtgtgc

SEQ ID NO: 682936 - DNA, 25 bp, Rattus norvegicus
ttggtatcccaattcactcgtgtgc

SEQ ID NO: 682937 - DNA, 25 bp, Rattus norvegicus
ttggtatccttgacagctccagagt

SEQ ID NO: 682938 - DNA, 25 bp, Rattus norvegicus
ttggtatccttgtcagctccagagt

SEQ ID NO: 682939 - DNA, 25 bp, Rattus norvegicus
ttggtatgggctccccatgaatttc

SEQ ID NO: 682940 - DNA, 25 bp, Rattus norvegicus
ttggtatgggctgcccatgaatttc

SEQ ID NO: 682941 - DNA, 25 bp, Rattus norvegicus
ttggtatgtgccaagcaagtactct

SEQ ID NO: 682942 - DNA, 25 bp, Rattus norvegicus
ttggtatgtgcctagcaagtactct

SEQ ID NO: 682943 - DNA, 25 bp, Rattus norvegicus
ttggtattattgacattttgttttc

SEQ ID NO: 682944 - DNA, 25 bp, Rattus norvegicus
ttggtattattgtcattttgttttc

SEQ ID NO: 682945 - DNA, 25 bp, Rattus norvegicus
ttggtattgagtatcttcttccctg

SEQ ID NO: 682946 - DNA, 25 bp, Rattus norvegicus
ttggtattgagtttcttcttccctg

SEQ ID NO: 682947 - DNA, 25 bp, Rattus norvegicus
ttggtattgttgactgaatctgccc

SEQ ID NO: 682948 - DNA, 25 bp, Rattus norvegicus
ttggtattgttgtctgaatctgccc

SEQ ID NO: 682949 - DNA, 25 bp, Rattus norvegicus
ttggtatttcaaagctcagcgggct

SEQ ID NO: 682950 - DNA, 25 bp, Rattus norvegicus
ttggtatttcaatgctcagcgggct

SEQ ID NO: 682951 - DNA, 25 bp, Rattus norvegicus
ttggtcaagggcactcagctggtca

SEQ ID NO: 682952 - DNA, 25 bp, Rattus norvegicus
ttggtcaagggctctcagctggtca

SEQ ID NO: 682953 - DNA, 25 bp, Rattus norvegicus
ttggtcaataacacctcctttcttc

SEQ ID NO: 682954 - DNA, 25 bp, Rattus norvegicus
ttggtcaataactcctcctttcttc

SEQ ID NO: 682955 - DNA, 25 bp, Rattus norvegicus
ttggtcacaacccttagcgctgtaa

SEQ ID NO: 682956 - DNA, 25 bp, Rattus norvegicus
ttggtcacaaccgttagcgctgtaa

SEQ ID NO: 682957 - DNA, 25 bp, Rattus norvegicus
ttggtcacagatcctcaatcctagg

SEQ ID NO: 682958 - DNA, 25 bp, Rattus norvegicus
ttggtcacagatgctcaatcctagg

SEQ ID NO: 682959 - DNA, 25 bp, Rattus norvegicus
ttggtcacagctcatttggcccaca

SEQ ID NO: 682960 - DNA, 25 bp, Rattus norvegicus
ttggtcacagctgatttggcccaca

SEQ ID NO: 682961 - DNA, 25 bp, Rattus norvegicus
ttggtcacatcactagctctctagg

SEQ ID NO: 682962 - DNA, 25 bp, Rattus norvegicus
ttggtcacatcagtagctctctagg

SEQ ID NO: 682963 - DNA, 25 bp, Rattus norvegicus
ttggtcaccatgactccaggattca

SEQ ID NO: 682964 - DNA, 25 bp, Rattus norvegicus
ttggtcaccatgtctccaggattca

SEQ ID NO: 682965 - DNA, 25 bp, Rattus norvegicus
ttggtcacccaaaaatctttgctca

SEQ ID NO: 682966 - DNA, 25 bp, Rattus norvegicus
ttggtcacccaataatctttgctca

SEQ ID NO: 682967 - DNA, 25 bp, Rattus norvegicus
ttggtcacctgcacaacatgttact

SEQ ID NO: 682968 - DNA, 25 bp, Rattus norvegicus
ttggtcacctgctcaacatgttact

SEQ ID NO: 682969 - DNA, 25 bp, Rattus norvegicus
ttggtcacgctgactggcagtagct

SEQ ID NO: 682970 - DNA, 25 bp, Rattus norvegicus
ttggtcacgctgtctggcagtagct

SEQ ID NO: 682971 - DNA, 25 bp, Rattus norvegicus
ttggtcacggacactaagcctttag

SEQ ID NO: 682972 - DNA, 25 bp, Rattus norvegicus
ttggtcacggactctaagcctttag

SEQ ID NO: 682973 - DNA, 25 bp, Rattus norvegicus
ttggtcacggatccccaagaaagaa

SEQ ID NO: 682974 - DNA, 25 bp, Rattus norvegicus
ttggtcacggatgcccaagaaagaa

SEQ ID NO: 682975 - DNA, 25 bp, Rattus norvegicus
ttggtcactgacatggcttgcccta

SEQ ID NO: 682976 - DNA, 25 bp, Rattus norvegicus
ttggtcactgacctgtggccagatc

SEQ ID NO: 682977 - DNA, 25 bp, Rattus norvegicus
ttggtcactgacgtgtggccagatc

SEQ ID NO: 682978 - DNA, 25 bp, Rattus norvegicus
ttggtcactgacttggcttgcccta

SEQ ID NO: 682979 - DNA, 25 bp, Rattus norvegicus
ttggtcacttgcagggtcgctagtc

SEQ ID NO: 682980 - DNA, 25 bp, Rattus norvegicus
ttggtcacttgctgggtcgctagtc

SEQ ID NO: 682981 - DNA, 25 bp, Rattus norvegicus
ttggtcagagccagtgcccagagtc

SEQ ID NO: 682982 - DNA, 25 bp, Rattus norvegicus
ttggtcagagcctgtgcccagagtc

SEQ ID NO: 682983 - DNA, 25 bp, Rattus norvegicus
ttggtcagccatccagaagttctgt

SEQ ID NO: 682984 - DNA, 25 bp, Rattus norvegicus
ttggtcagccatgcagaagttctgt

SEQ ID NO: 682985 - DNA, 25 bp, Rattus norvegicus
ttggtcagtcaaatgcttgccacac

SEQ ID NO: 682986 - DNA, 25 bp, Rattus norvegicus
ttggtcagtcaattgcttgccacac

SEQ ID NO: 682987 - DNA, 25 bp, Rattus norvegicus
ttggtcagtcacacaaagctcttac

SEQ ID NO: 682988 - DNA, 25 bp, Rattus norvegicus
ttggtcagtcactcaaagctcttac

SEQ ID NO: 682989 - DNA, 25 bp, Rattus norvegicus
ttggtcataccaaggtgtcccaggt

SEQ ID NO: 682990 - DNA, 25 bp, Rattus norvegicus
ttggtcataccatggtgtcccaggt

SEQ ID NO: 682991 - DNA, 25 bp, Rattus norvegicus
ttggtcatactgagggaagcgcttt

SEQ ID NO: 682992 - DNA, 25 bp, Rattus norvegicus
ttggtcatactgtgggaagcgcttt

SEQ ID NO: 682993 - DNA, 25 bp, Rattus norvegicus
ttggtcatccaacagcgggagaagt

SEQ ID NO: 682994 - DNA, 25 bp, Rattus norvegicus
ttggtcatccaagagcgggagaagt

SEQ ID NO: 682995 - DNA, 25 bp, Rattus norvegicus
ttggtcatccctaggtgtcattgtc

SEQ ID NO: 682996 - DNA, 25 bp, Rattus norvegicus
ttggtcatcccttggtgtcattgtc

SEQ ID NO: 682997 - DNA, 25 bp, Rattus norvegicus
ttggtcatctgtcgccccggaaata

SEQ ID NO: 682998 - DNA, 25 bp, Rattus norvegicus
ttggtcatctgtggccccggaaata

SEQ ID NO: 682999 - DNA, 25 bp, Rattus norvegicus
ttggtcatgctaatccttacagtgt

SEQ ID NO: 683000 - DNA, 25 bp, Rattus norvegicus
ttggtcatgctattccttacagtgt

SEQ ID NO: 683001 - DNA, 25 bp, Rattus norvegicus
ttggtcatttgacccgcactgtcaa

SEQ ID NO: 683002 - DNA, 25 bp, Rattus norvegicus
ttggtcatttgagccgcactgtcaa

SEQ ID NO: 683003 - DNA, 25 bp, Rattus norvegicus
ttggtcattttacccacccaccgag

SEQ ID NO: 683004 - DNA, 25 bp, Rattus norvegicus
ttggtcattttagccacccaccgag

SEQ ID NO: 683005 - DNA, 25 bp, Rattus norvegicus
ttggtccaaaggcaagaaccccact

SEQ ID NO: 683006 - DNA, 25 bp, Rattus norvegicus
ttggtccaaagggaagaaccccact

SEQ ID NO: 683007 - DNA, 25 bp, Rattus norvegicus
ttggtccaagcccatgcgtagttct

SEQ ID NO: 683008 - DNA, 25 bp, Rattus norvegicus
ttggtccaagccgatgcgtagttct

SEQ ID NO: 683009 - DNA, 25 bp, Rattus norvegicus
ttggtccacactctctgctgagagg

SEQ ID NO: 683010 - DNA, 25 bp, Rattus norvegicus
ttggtccacactgtctgctgagagg

SEQ ID NO: 683011 - DNA, 25 bp, Rattus norvegicus
ttggtccaccaacactactgtatgg

SEQ ID NO: 683012 - DNA, 25 bp, Rattus norvegicus
ttggtccaccaagactactgtatgg

SEQ ID NO: 683013 - DNA, 25 bp, Rattus norvegicus
ttggtccaccgtcagtatgctatgt

SEQ ID NO: 683014 - DNA, 25 bp, Rattus norvegicus
ttggtccaccgtgagtatgctatgt

SEQ ID NO: 683015 - DNA, 25 bp, Rattus norvegicus
ttggtccatggccactgacacagta

SEQ ID NO: 683016 - DNA, 25 bp, Rattus norvegicus
ttggtccatggcgactgacacagta

SEQ ID NO: 683017 - DNA, 25 bp, Rattus norvegicus
ttggtccattagcatcacatgtcgc

SEQ ID NO: 683018 - DNA, 25 bp, Rattus norvegicus
ttggtccattaggatcacatgtcgc

SEQ ID NO: 683019 - DNA, 25 bp, Rattus norvegicus
ttggtcccatctcctatgctatgca

SEQ ID NO: 683020 - DNA, 25 bp, Rattus norvegicus
ttggtcccatctgctatgctatgca

SEQ ID NO: 683021 - DNA, 25 bp, Rattus norvegicus
ttggtccccacaatagcaggccttg

SEQ ID NO: 683022 - DNA, 25 bp, Rattus norvegicus
ttggtccccacattagcaggccttg

SEQ ID NO: 683023 - DNA, 25 bp, Rattus norvegicus
ttggtccccaggagggacaagggat

SEQ ID NO: 683024 - DNA, 25 bp, Rattus norvegicus
ttggtccccaggtgggacaagggat

SEQ ID NO: 683025 - DNA, 25 bp, Rattus norvegicus
ttggtcccctgcaaaaccttataga

SEQ ID NO: 683026 - DNA, 25 bp, Rattus norvegicus
ttggtcccctgctaaaccttataga

SEQ ID NO: 683027 - DNA, 25 bp, Rattus norvegicus
ttggtcccgagcagacaccagagca

SEQ ID NO: 683028 - DNA, 25 bp, Rattus norvegicus
ttggtcccgagctgacaccagagca

SEQ ID NO: 683029 - DNA, 25 bp, Rattus norvegicus
ttggtccctgtacccactgtgaaat

SEQ ID NO: 683030 - DNA, 25 bp, Rattus norvegicus
ttggtccctgtagccactgtgaaat

SEQ ID NO: 683031 - DNA, 25 bp, Rattus norvegicus
ttggtccctgtgcaccttaaaagtc

SEQ ID NO: 683032 - DNA, 25 bp, Rattus norvegicus
ttggtccctgtggaccttaaaagtc

SEQ ID NO: 683033 - DNA, 25 bp, Rattus norvegicus
ttggtcccttgtctacgctaagtgc

SEQ ID NO: 683034 - DNA, 25 bp, Rattus norvegicus
ttggtcccttgtgtacgctaagtgc

SEQ ID NO: 683035 - DNA, 25 bp, Rattus norvegicus
ttggtcctaacaaaggcggcagcgc

SEQ ID NO: 683036 - DNA, 25 bp, Rattus norvegicus
ttggtcctaacataggcggcagcgc

SEQ ID NO: 683037 - DNA, 25 bp, Rattus norvegicus
ttggtcctaagacactcctggcaaa

SEQ ID NO: 683038 - DNA, 25 bp, Rattus norvegicus
ttggtcctaagagactcctggcaaa

SEQ ID NO: 683039 - DNA, 25 bp, Rattus norvegicus
ttggtcctaagcaactggcccataa

SEQ ID NO: 683040 - DNA, 25 bp, Rattus norvegicus
ttggtcctaagctactggcccataa

SEQ ID NO: 683041 - DNA, 25 bp, Rattus norvegicus
ttggtcctaattctattcccttgat

SEQ ID NO: 683042 - DNA, 25 bp, Rattus norvegicus
ttggtcctaattgtattcccttgat

SEQ ID NO: 683043 - DNA, 25 bp, Rattus norvegicus
ttggtcctactgaagaatctgtcgg

SEQ ID NO: 683044 - DNA, 25 bp, Rattus norvegicus
ttggtcctactgtagaatctgtcgg

SEQ ID NO: 683045 - DNA, 25 bp, Rattus norvegicus
ttggtcctacttaaaagcgtgggct

SEQ ID NO: 683046 - DNA, 25 bp, Rattus norvegicus
ttggtcctactttaaagcgtgggct

SEQ ID NO: 683047 - DNA, 25 bp, Rattus norvegicus
ttggtcctcaggagcagatgtccag

SEQ ID NO: 683048 - DNA, 25 bp, Rattus norvegicus
ttggtcctcaggtgcagatgtccag

SEQ ID NO: 683049 - DNA, 25 bp, Rattus norvegicus
ttggtcctcctactggaacatccat

SEQ ID NO: 683050 - DNA, 25 bp, Rattus norvegicus
ttggtcctcctagtggaacatccat

SEQ ID NO: 683051 - DNA, 25 bp, Rattus norvegicus
ttggtcctctatccttcaagtaaag

SEQ ID NO: 683052 - DNA, 25 bp, Rattus norvegicus
ttggtcctctatgcttcaagtaaag

SEQ ID NO: 683053 - DNA, 25 bp, Rattus norvegicus
ttggtcctgcaacgccagtgagaca

SEQ ID NO: 683054 - DNA, 25 bp, Rattus norvegicus
ttggtcctgcaaggccagtgagaca

SEQ ID NO: 683055 - DNA, 25 bp, Rattus norvegicus
ttggtcctgctcagaaactgcagca

SEQ ID NO: 683056 - DNA, 25 bp, Rattus norvegicus
ttggtcctgctctgaaactgcagca

SEQ ID NO: 683057 - DNA, 25 bp, Rattus norvegicus
ttggtcctgctgagtctgcctctta

SEQ ID NO: 683058 - DNA, 25 bp, Rattus norvegicus
ttggtcctgctgtgtctgcctctta

SEQ ID NO: 683059 - DNA, 25 bp, Rattus norvegicus
ttggtcctgggactggcactatcag

SEQ ID NO: 683060 - DNA, 25 bp, Rattus norvegicus
ttggtcctgggagtggcactatcag

SEQ ID NO: 683061 - DNA, 25 bp, Rattus norvegicus
ttggtcctgttcagtttacttcttc

SEQ ID NO: 683062 - DNA, 25 bp, Rattus norvegicus
ttggtcctgttctgtttacttcttc

SEQ ID NO: 683063 - DNA, 25 bp, Rattus norvegicus
ttggtccttctcatactcttggtaa

SEQ ID NO: 683064 - DNA, 25 bp, Rattus norvegicus
ttggtccttctcttactcttggtaa

SEQ ID NO: 683065 - DNA, 25 bp, Rattus norvegicus
ttggtcgcgcttcacaccgggctga

SEQ ID NO: 683066 - DNA, 25 bp, Rattus norvegicus
ttggtcgcgcttgacaccgggctga

SEQ ID NO: 683067 - DNA, 25 bp, Rattus norvegicus
ttggtcgctgacagttctccaggca

SEQ ID NO: 683068 - DNA, 25 bp, Rattus norvegicus
ttggtcgctgactgttctccaggca

SEQ ID NO: 683069 - DNA, 25 bp, Rattus norvegicus
ttggtcggaactaggtccctgggct

SEQ ID NO: 683070 - DNA, 25 bp, Rattus norvegicus
ttggtcggaacttggtccctgggct

SEQ ID NO: 683071 - DNA, 25 bp, Rattus norvegicus
ttggtcggttggcatgcccacagaa

SEQ ID NO: 683072 - DNA, 25 bp, Rattus norvegicus
ttggtcggttgggatgcccacagaa

SEQ ID NO: 683073 - DNA, 25 bp, Rattus norvegicus
ttggtcgtcaatattctttgccctg

SEQ ID NO: 683074 - DNA, 25 bp, Rattus norvegicus
ttggtcgtcaattttctttgccctg

SEQ ID NO: 683075 - DNA, 25 bp, Rattus norvegicus
ttggtcgtccatactttcttaaata

SEQ ID NO: 683076 - DNA, 25 bp, Rattus norvegicus
ttggtcgtccattctttcttaaata

SEQ ID NO: 683077 - DNA, 25 bp, Rattus norvegicus
ttggtcgtgttgactggttgatcat

SEQ ID NO: 683078 - DNA, 25 bp, Rattus norvegicus
ttggtcgtgttgtctggttgatcat

SEQ ID NO: 683079 - DNA, 25 bp, Rattus norvegicus
ttggtcgttagcctttcaccatctc

SEQ ID NO: 683080 - DNA, 25 bp, Rattus norvegicus
ttggtcgttagcgtttcaccatctc

SEQ ID NO: 683081 - DNA, 25 bp, Rattus norvegicus
ttggtcgttttgctgttcgtgacat

SEQ ID NO: 683082 - DNA, 25 bp, Rattus norvegicus
ttggtcgttttggtgttcgtgacat

SEQ ID NO: 683083 - DNA, 25 bp, Rattus norvegicus
ttggtctactccatgttggttttca

SEQ ID NO: 683084 - DNA, 25 bp, Rattus norvegicus
ttggtctactccttgttggttttca

SEQ ID NO: 683085 - DNA, 25 bp, Rattus norvegicus
ttggtctagacacctattttcccct

SEQ ID NO: 683086 - DNA, 25 bp, Rattus norvegicus
ttggtctagacagctattttcccct

SEQ ID NO: 683087 - DNA, 25 bp, Rattus norvegicus
ttggtctcaggccaggtccacaact

SEQ ID NO: 683088 - DNA, 25 bp, Rattus norvegicus
ttggtctcaggcgaggtccacaact

SEQ ID NO: 683089 - DNA, 25 bp, Rattus norvegicus
ttggtctcagttatctggtgttcgt

SEQ ID NO: 683090 - DNA, 25 bp, Rattus norvegicus
ttggtctcagttttctggtgttcgt

SEQ ID NO: 683091 - DNA, 25 bp, Rattus norvegicus
ttggtctccagcacttcgatatcat

SEQ ID NO: 683092 - DNA, 25 bp, Rattus norvegicus
ttggtctccagctcttcgatatcat

SEQ ID NO: 683093 - DNA, 25 bp, Rattus norvegicus
ttggtctcccggatgcacatggtgg

SEQ ID NO: 683094 - DNA, 25 bp, Rattus norvegicus
ttggtctcccggttgcacatggtgg

SEQ ID NO: 683095 - DNA, 25 bp, Rattus norvegicus
ttggtctcctgtcttgggctactga

SEQ ID NO: 683096 - DNA, 25 bp, Rattus norvegicus
ttggtctcctgtgttgggctactga

SEQ ID NO: 683097 - DNA, 25 bp, Rattus norvegicus
ttggtctctataatctggccttgga

SEQ ID NO: 683098 - DNA, 25 bp, Rattus norvegicus
ttggtctctatattctggccttgga

SEQ ID NO: 683099 - DNA, 25 bp, Rattus norvegicus
ttggtctctcaaataggtcctccag

SEQ ID NO: 683100 - DNA, 25 bp, Rattus norvegicus
ttggtctctcaattaggtcctccag

SEQ ID NO: 683101 - DNA, 25 bp, Rattus norvegicus
ttggtctgctgccatttgtcacact

SEQ ID NO: 683102 - DNA, 25 bp, Rattus norvegicus
ttggtctgctgcgatttgtcacact

SEQ ID NO: 683103 - DNA, 25 bp, Rattus norvegicus
ttggtctggagcagtgattgtcatc

SEQ ID NO: 683104 - DNA, 25 bp, Rattus norvegicus
ttggtctggagctgtgattgtcatc

SEQ ID NO: 683105 - DNA, 25 bp, Rattus norvegicus
ttggtctggtcacggccttcctcat

SEQ ID NO: 683106 - DNA, 25 bp, Rattus norvegicus
ttggtctggtcagggccttcctcat

SEQ ID NO: 683107 - DNA, 25 bp, Rattus norvegicus
ttggtctggtctcaacggtcaccat

SEQ ID NO: 683108 - DNA, 25 bp, Rattus norvegicus
ttggtctggtctgaacggtcaccat

SEQ ID NO: 683109 - DNA, 25 bp, Rattus norvegicus
ttggtctgttttaggttcgttcatt

SEQ ID NO: 683110 - DNA, 25 bp, Rattus norvegicus
ttggtctgtttttggttcgttcatt

SEQ ID NO: 683111 - DNA, 25 bp, Rattus norvegicus
ttggtcttaactctgctttttcccg

SEQ ID NO: 683112 - DNA, 25 bp, Rattus norvegicus
ttggtcttaactgtgctttttcccg

SEQ ID NO: 683113 - DNA, 25 bp, Rattus norvegicus
ttggtcttatctctttactctctga

SEQ ID NO: 683114 - DNA, 25 bp, Rattus norvegicus
ttggtcttatctgtttactctctga

SEQ ID NO: 683115 - DNA, 25 bp, Rattus norvegicus
ttggtcttctaccacatacactgtg

SEQ ID NO: 683116 - DNA, 25 bp, Rattus norvegicus
ttggtcttctacgacatacactgtg

SEQ ID NO: 683117 - DNA, 25 bp, Rattus norvegicus
ttggtcttctcccttcaattagaaa

SEQ ID NO: 683118 - DNA, 25 bp, Rattus norvegicus
ttggtcttctccgttcaattagaaa

SEQ ID NO: 683119 - DNA, 25 bp, Rattus norvegicus
ttggtcttcttgattttcctcagaa

SEQ ID NO: 683120 - DNA, 25 bp, Rattus norvegicus
ttggtcttcttgtttttcctcagaa

SEQ ID NO: 683121 - DNA, 25 bp, Rattus norvegicus
ttggtcttgaagctgcatctccaga

SEQ ID NO: 683122 - DNA, 25 bp, Rattus norvegicus
ttggtcttgaaggtgcatctccaga

SEQ ID NO: 683123 - DNA, 25 bp, Rattus norvegicus
ttggtcttggacacacgtgcttgat

SEQ ID NO: 683124 - DNA, 25 bp, Rattus norvegicus
ttggtcttggactcacgtgcttgat

SEQ ID NO: 683125 - DNA, 25 bp, Rattus norvegicus
ttggtctttcaacttaaggctctat

SEQ ID NO: 683126 - DNA, 25 bp, Rattus norvegicus
ttggtctttcaagttaaggctctat

SEQ ID NO: 683127 - DNA, 25 bp, Rattus norvegicus
ttggtctttcccatacactaaagag

SEQ ID NO: 683128 - DNA, 25 bp, Rattus norvegicus
ttggtctttcccttacactaaagag

SEQ ID NO: 683129 - DNA, 25 bp, Rattus norvegicus
ttggtgaaaaccagacctccagtgc

SEQ ID NO: 683130 - DNA, 25 bp, Rattus norvegicus
ttggtgaaaacctgacctccagtgc

SEQ ID NO: 683131 - DNA, 25 bp, Rattus norvegicus
ttggtgaacaccatcaacactgatt

SEQ ID NO: 683132 - DNA, 25 bp, Rattus norvegicus
ttggtgaacaccttcaacactgatt

SEQ ID NO: 683133 - DNA, 25 bp, Rattus norvegicus
ttggtgaagaggaggcccatcccac

SEQ ID NO: 683134 - DNA, 25 bp, Rattus norvegicus
ttggtgaagaggtggcccatcccac

SEQ ID NO: 683135 - DNA, 25 bp, Rattus norvegicus
ttggtgaaggcaacctgtccacagc

SEQ ID NO: 683136 - DNA, 25 bp, Rattus norvegicus
ttggtgaaggcatcctgtccacagc

SEQ ID NO: 683137 - DNA, 25 bp, Rattus norvegicus
ttggtgaagtgtccatcaggcccgc

SEQ ID NO: 683138 - DNA, 25 bp, Rattus norvegicus
ttggtgaagtgtgcatcaggcccgc

SEQ ID NO: 683139 - DNA, 25 bp, Rattus norvegicus
ttggtgacaagcatcttccttctct

SEQ ID NO: 683140 - DNA, 25 bp, Rattus norvegicus
ttggtgacaagcttcttccttctct

SEQ ID NO: 683141 - DNA, 25 bp, Rattus norvegicus
ttggtgacagcaaccaatgcagcgt

SEQ ID NO: 683142 - DNA, 25 bp, Rattus norvegicus
ttggtgacagcatccaatgcagcgt

SEQ ID NO: 683143 - DNA, 25 bp, Rattus norvegicus
ttggtgacattcatcagctcctcct

SEQ ID NO: 683144 - DNA, 25 bp, Rattus norvegicus
ttggtgacattcttcagctcctcct

SEQ ID NO: 683145 - DNA, 25 bp, Rattus norvegicus
ttggtgaccccaagtttaagcctgt

SEQ ID NO: 683146 - DNA, 25 bp, Rattus norvegicus
ttggtgaccccatgtttaagcctgt

SEQ ID NO: 683147 - DNA, 25 bp, Rattus norvegicus
ttggtgacccctatgttacccaatg

SEQ ID NO: 683148 - DNA, 25 bp, Rattus norvegicus
ttggtgacccctttgttacccaatg

SEQ ID NO: 683149 - DNA, 25 bp, Rattus norvegicus
ttggtgacctgaaccaggagaccct

SEQ ID NO: 683150 - DNA, 25 bp, Rattus norvegicus
ttggtgacctgatccaggagaccct

SEQ ID NO: 683151 - DNA, 25 bp, Rattus norvegicus
ttggtgactcctcctattactaaat

SEQ ID NO: 683152 - DNA, 25 bp, Rattus norvegicus
ttggtgactcctgctattactaaat

SEQ ID NO: 683153 - DNA, 25 bp, Rattus norvegicus
ttggtgactctacttcctgtatagt

SEQ ID NO: 683154 - DNA, 25 bp, Rattus norvegicus
ttggtgactctagttcctgtatagt

SEQ ID NO: 683155 - DNA, 25 bp, Rattus norvegicus
ttggtgagacccaggtccctgcttt

SEQ ID NO: 683156 - DNA, 25 bp, Rattus norvegicus
ttggtgagaccctggtccctgcttt

SEQ ID NO: 683157 - DNA, 25 bp, Rattus norvegicus
ttggtgaggtcaaaagccatgcttt

SEQ ID NO: 683158 - DNA, 25 bp, Rattus norvegicus
ttggtgaggtcataagccatgcttt

SEQ ID NO: 683159 - DNA, 25 bp, Rattus norvegicus
ttggtgatctggactctgggagaac

SEQ ID NO: 683160 - DNA, 25 bp, Rattus norvegicus
ttggtgatctggtctctgggagaac

SEQ ID NO: 683161 - DNA, 25 bp, Rattus norvegicus
ttggtgatgaatacacttgggcccc

SEQ ID NO: 683162 - DNA, 25 bp, Rattus norvegicus
ttggtgatgaattcacttgggcccc

SEQ ID NO: 683163 - DNA, 25 bp, Rattus norvegicus
ttggtgatgaccatgcagccgtgct

SEQ ID NO: 683164 - DNA, 25 bp, Rattus norvegicus
ttggtgatgaccttgcagccgtgct

SEQ ID NO: 683165 - DNA, 25 bp, Rattus norvegicus
ttggtgatgtttccatctaccctcc

SEQ ID NO: 683166 - DNA, 25 bp, Rattus norvegicus
ttggtgatgtttgcatctaccctcc

SEQ ID NO: 683167 - DNA, 25 bp, Rattus norvegicus
ttggtgattgggactcctctgctgt

SEQ ID NO: 683168 - DNA, 25 bp, Rattus norvegicus
ttggtgattgggtctcctctgctgt

SEQ ID NO: 683169 - DNA, 25 bp, Rattus norvegicus
ttggtgcaagctaacgctgtcttaa

SEQ ID NO: 683170 - DNA, 25 bp, Rattus norvegicus
ttggtgcaagcttacgctgtcttaa

SEQ ID NO: 683171 - DNA, 25 bp, Rattus norvegicus
ttggtgcaatgtatagtggctgttt

SEQ ID NO: 683172 - DNA, 25 bp, Rattus norvegicus
ttggtgcaatgtttagtggctgttt

SEQ ID NO: 683173 - DNA, 25 bp, Rattus norvegicus
ttggtgcactttatgcgcgaactag

SEQ ID NO: 683174 - DNA, 25 bp, Rattus norvegicus
ttggtgcactttttgcgcgaactag

SEQ ID NO: 683175 - DNA, 25 bp, Rattus norvegicus
ttggtgcagagaaaaccgcccgctg

SEQ ID NO: 683176 - DNA, 25 bp, Rattus norvegicus
ttggtgcagagataaccgcccgctg

SEQ ID NO: 683177 - DNA, 25 bp, Rattus norvegicus
ttggtgcagagtacccagcgcggcg

SEQ ID NO: 683178 - DNA, 25 bp, Rattus norvegicus
ttggtgcagagttcccagcgcggcg

SEQ ID NO: 683179 - DNA, 25 bp, Rattus norvegicus
ttggtgcaggtcctggcttctagaa

SEQ ID NO: 683180 - DNA, 25 bp, Rattus norvegicus
ttggtgcaggtcgtggcttctagaa

SEQ ID NO: 683181 - DNA, 25 bp, Rattus norvegicus
ttggtgcagttcactggagtgcctg

SEQ ID NO: 683182 - DNA, 25 bp, Rattus norvegicus
ttggtgcagttctctggagtgcctg

SEQ ID NO: 683183 - DNA, 25 bp, Rattus norvegicus
ttggtgcatgttaatttttcgtatc

SEQ ID NO: 683184 - DNA, 25 bp, Rattus norvegicus
ttggtgcatgtttatttttcgtatc

SEQ ID NO: 683185 - DNA, 25 bp, Rattus norvegicus
ttggtgccacacacctataattcta

SEQ ID NO: 683186 - DNA, 25 bp, Rattus norvegicus
ttggtgccacactcctataattcta

SEQ ID NO: 683187 - DNA, 25 bp, Rattus norvegicus
ttggtgccagagatcatccagctgc

SEQ ID NO: 683188 - DNA, 25 bp, Rattus norvegicus
ttggtgccagagttcatccagctgc

SEQ ID NO: 683189 - DNA, 25 bp, Rattus norvegicus
ttggtgccagttagagacgatgtat

SEQ ID NO: 683190 - DNA, 25 bp, Rattus norvegicus
ttggtgccagtttgagacgatgtat

SEQ ID NO: 683191 - DNA, 25 bp, Rattus norvegicus
ttggtgcccaaaatcctgacttcat

SEQ ID NO: 683192 - DNA, 25 bp, Rattus norvegicus
ttggtgcccaaattcctgacttcat

SEQ ID NO: 683193 - DNA, 25 bp, Rattus norvegicus
ttggtgcccagactcattgaagtac

SEQ ID NO: 683194 - DNA, 25 bp, Rattus norvegicus
ttggtgcccagagtcattgaagtac

SEQ ID NO: 683195 - DNA, 25 bp, Rattus norvegicus
ttggtgcccatgaggtgaccgccat

SEQ ID NO: 683196 - DNA, 25 bp, Rattus norvegicus
ttggtgcccatgtggtgaccgccat

SEQ ID NO: 683197 - DNA, 25 bp, Rattus norvegicus
ttggtgcccgttcatgtgacatttg

SEQ ID NO: 683198 - DNA, 25 bp, Rattus norvegicus
ttggtgcccgttgatgtgacatttg

SEQ ID NO: 683199 - DNA, 25 bp, Rattus norvegicus
ttggtgccctacagtttcttggact

SEQ ID NO: 683200 - DNA, 25 bp, Rattus norvegicus
ttggtgccctactgtttcttggact

SEQ ID NO: 683201 - DNA, 25 bp, Rattus norvegicus
ttggtgccctatcagcagttgtgct

SEQ ID NO: 683202 - DNA, 25 bp, Rattus norvegicus
ttggtgccctatgagcagttgtgct

SEQ ID NO: 683203 - DNA, 25 bp, Rattus norvegicus
ttggtgccgccgcaggccttgtgcg

SEQ ID NO: 683204 - DNA, 25 bp, Rattus norvegicus
ttggtgccgccggaggccttgtgcg

SEQ ID NO: 683205 - DNA, 25 bp, Rattus norvegicus
ttggtgcctcacaggtccctaggtg

SEQ ID NO: 683206 - DNA, 25 bp, Rattus norvegicus
ttggtgcctcactggtccctaggtg

SEQ ID NO: 683207 - DNA, 25 bp, Rattus norvegicus
ttggtgcctcagatgcatggcgtgt

SEQ ID NO: 683208 - DNA, 25 bp, Rattus norvegicus
ttggtgcctcagttgcatggcgtgt

SEQ ID NO: 683209 - DNA, 25 bp, Rattus norvegicus
ttggtgcctgtcatccatggaggag

SEQ ID NO: 683210 - DNA, 25 bp, Rattus norvegicus
ttggtgcctgtcttccatggaggag

SEQ ID NO: 683211 - DNA, 25 bp, Rattus norvegicus
ttggtgcctgttctgttgactttaa

SEQ ID NO: 683212 - DNA, 25 bp, Rattus norvegicus
ttggtgcctgttgtgttgactttaa

SEQ ID NO: 683213 - DNA, 25 bp, Rattus norvegicus
ttggtgccttccctgtcatgataga

SEQ ID NO: 683214 - DNA, 25 bp, Rattus norvegicus
ttggtgccttccgtgtcatgataga

SEQ ID NO: 683215 - DNA, 25 bp, Rattus norvegicus
ttggtgcggtcaaggcgtaagccca

SEQ ID NO: 683216 - DNA, 25 bp, Rattus norvegicus
ttggtgcggtcatggcgtaagccca

SEQ ID NO: 683217 - DNA, 25 bp, Rattus norvegicus
ttggtgctaccgacttggtgtacat

SEQ ID NO: 683218 - DNA, 25 bp, Rattus norvegicus
ttggtgctaccgtcttggtgtacat

SEQ ID NO: 683219 - DNA, 25 bp, Rattus norvegicus
ttggtgctagatctccgtcactgtg

SEQ ID NO: 683220 - DNA, 25 bp, Rattus norvegicus
ttggtgctagatgtccgtcactgtg

SEQ ID NO: 683221 - DNA, 25 bp, Rattus norvegicus
ttggtgctctctcccggtttcagtg

SEQ ID NO: 683222 - DNA, 25 bp, Rattus norvegicus
ttggtgctctctgccggtttcagtg

SEQ ID NO: 683223 - DNA, 25 bp, Rattus norvegicus
ttggtgctgaacagtggttagagat

SEQ ID NO: 683224 - DNA, 25 bp, Rattus norvegicus
ttggtgctgaactgtggttagagat

SEQ ID NO: 683225 - DNA, 25 bp, Rattus norvegicus
ttggtgctgcacctgtagcctacgg

SEQ ID NO: 683226 - DNA, 25 bp, Rattus norvegicus
ttggtgctgcacgtgtagcctacgg

SEQ ID NO: 683227 - DNA, 25 bp, Rattus norvegicus
ttggtgctgctgacctctattactc

SEQ ID NO: 683228 - DNA, 25 bp, Rattus norvegicus
ttggtgctgctgtcctctattactc

SEQ ID NO: 683229 - DNA, 25 bp, Rattus norvegicus
ttggtgctggagcaactgagcccct

SEQ ID NO: 683230 - DNA, 25 bp, Rattus norvegicus
ttggtgctggaggaactgagcccct

SEQ ID NO: 683231 - DNA, 25 bp, Rattus norvegicus
ttggtgctggccatcagtgctgagc

SEQ ID NO: 683232 - DNA, 25 bp, Rattus norvegicus
ttggtgctggccttcagtgctgagc

SEQ ID NO: 683233 - DNA, 25 bp, Rattus norvegicus
ttggtgcttccgaggagccggcagc

SEQ ID NO: 683234 - DNA, 25 bp, Rattus norvegicus
ttggtgcttccgtggagccggcagc

SEQ ID NO: 683235 - DNA, 25 bp, Rattus norvegicus
ttggtggaacgtacctaccccagct

SEQ ID NO: 683236 - DNA, 25 bp, Rattus norvegicus
ttggtggaacgttcctaccccagct

SEQ ID NO: 683237 - DNA, 25 bp, Rattus norvegicus
ttggtggaagctctctacctggtgt

SEQ ID NO: 683238 - DNA, 25 bp, Rattus norvegicus
ttggtggaagctgtctacctggtgt

SEQ ID NO: 683239 - DNA, 25 bp, Rattus norvegicus
ttggtggacacaccttctctggaga

SEQ ID NO: 683240 - DNA, 25 bp, Rattus norvegicus
ttggtggacacagcttctctggaga

SEQ ID NO: 683241 - DNA, 25 bp, Rattus norvegicus
ttggtggaccaaatgcctgactcgt

SEQ ID NO: 683242 - DNA, 25 bp, Rattus norvegicus
ttggtggaccaactgggtgatccca

SEQ ID NO: 683243 - DNA, 25 bp, Rattus norvegicus
ttggtggaccaagtgggtgatccca

SEQ ID NO: 683244 - DNA, 25 bp, Rattus norvegicus
ttggtggaccaattgcctgactcgt

SEQ ID NO: 683245 - DNA, 25 bp, Rattus norvegicus
ttggtggaccaccagagatttttta

SEQ ID NO: 683246 - DNA, 25 bp, Rattus norvegicus
ttggtggaccacgagagatttttta

SEQ ID NO: 683247 - DNA, 25 bp, Rattus norvegicus
ttggtggaccatccttgactcagtg

SEQ ID NO: 683248 - DNA, 25 bp, Rattus norvegicus
ttggtggaccatgcttgactcagtg

SEQ ID NO: 683249 - DNA, 25 bp, Rattus norvegicus
ttggtggacctcatgcttgtcagtg

SEQ ID NO: 683250 - DNA, 25 bp, Rattus norvegicus
ttggtggacctcttgcttgtcagtg

SEQ ID NO: 683251 - DNA, 25 bp, Rattus norvegicus
ttggtggagggcacgtagcactcca

SEQ ID NO: 683252 - DNA, 25 bp, Rattus norvegicus
ttggtggagggctcgtagcactcca

SEQ ID NO: 683253 - DNA, 25 bp, Rattus norvegicus
ttggtggagttcactggctctgcag

SEQ ID NO: 683254 - DNA, 25 bp, Rattus norvegicus
ttggtggagttctctggctctgcag

SEQ ID NO: 683255 - DNA, 25 bp, Rattus norvegicus
ttggtggatcatcaaccccgatggg

SEQ ID NO: 683256 - DNA, 25 bp, Rattus norvegicus
ttggtggatcatgaaccccgatggg

SEQ ID NO: 683257 - DNA, 25 bp, Rattus norvegicus
ttggtggattgtaaagtgctgtgct

SEQ ID NO: 683258 - DNA, 25 bp, Rattus norvegicus
ttggtggattgttaagtgctgtgct

SEQ ID NO: 683259 - DNA, 25 bp, Rattus norvegicus
ttggtggcacctctggttgtcaatg

SEQ ID NO: 683260 - DNA, 25 bp, Rattus norvegicus
ttggtggcacctgtggttgtcaatg

SEQ ID NO: 683261 - DNA, 25 bp, Rattus norvegicus
ttggtggcactcaggcctggaacac

SEQ ID NO: 683262 - DNA, 25 bp, Rattus norvegicus
ttggtggcactctggcctggaacac

SEQ ID NO: 683263 - DNA, 25 bp, Rattus norvegicus
ttggtggccactacgcggactccta

SEQ ID NO: 683264 - DNA, 25 bp, Rattus norvegicus
ttggtggccacttcgcggactccta

SEQ ID NO: 683265 - DNA, 25 bp, Rattus norvegicus
ttggtggctacacacttcgagggac

SEQ ID NO: 683266 - DNA, 25 bp, Rattus norvegicus
ttggtggctacagacttcgagggac

SEQ ID NO: 683267 - DNA, 25 bp, Rattus norvegicus
ttggtggctaccatggtcagagacc

SEQ ID NO: 683268 - DNA, 25 bp, Rattus norvegicus
ttggtggctaccttggtcagagacc

SEQ ID NO: 683269 - DNA, 25 bp, Rattus norvegicus
ttggtggctcagatggtttgactca

SEQ ID NO: 683270 - DNA, 25 bp, Rattus norvegicus
ttggtggctcagttggtttgactca

SEQ ID NO: 683271 - DNA, 25 bp, Rattus norvegicus
ttggtggctccaaccccttcgatat

SEQ ID NO: 683272 - DNA, 25 bp, Rattus norvegicus
ttggtggctccatccccttcgatat

SEQ ID NO: 683273 - DNA, 25 bp, Rattus norvegicus
ttggtgggaaatagcccagcccatt

SEQ ID NO: 683274 - DNA, 25 bp, Rattus norvegicus
ttggtgggaaattgcccagcccatt

SEQ ID NO: 683275 - DNA, 25 bp, Rattus norvegicus
ttggtgggaacactagcagcttctt

SEQ ID NO: 683276 - DNA, 25 bp, Rattus norvegicus
ttggtgggaacagtagcagcttctt

SEQ ID NO: 683277 - DNA, 25 bp, Rattus norvegicus
ttggtgggatgaaatgttccgcccc

SEQ ID NO: 683278 - DNA, 25 bp, Rattus norvegicus
ttggtgggatgatatgttccgcccc

SEQ ID NO: 683279 - DNA, 25 bp, Rattus norvegicus
ttggtgggcaccattcaggaaccag

SEQ ID NO: 683280 - DNA, 25 bp, Rattus norvegicus
ttggtgggcacctttcaggaaccag

SEQ ID NO: 683281 - DNA, 25 bp, Rattus norvegicus
ttggtgggccaaacatgtccttcac

SEQ ID NO: 683282 - DNA, 25 bp, Rattus norvegicus
ttggtgggccaatcatgtccttcac

SEQ ID NO: 683283 - DNA, 25 bp, Rattus norvegicus
ttggtgggcctacagcaagttgact

SEQ ID NO: 683284 - DNA, 25 bp, Rattus norvegicus
ttggtgggcctagagcaagttgact

SEQ ID NO: 683285 - DNA, 25 bp, Rattus norvegicus
ttggtgggctgaatttctggttttc

SEQ ID NO: 683286 - DNA, 25 bp, Rattus norvegicus
ttggtgggctgattttctggttttc

SEQ ID NO: 683287 - DNA, 25 bp, Rattus norvegicus
ttggtgggcttgatatgtggaaact

SEQ ID NO: 683288 - DNA, 25 bp, Rattus norvegicus
ttggtgggcttgttatgtggaaact

SEQ ID NO: 683289 - DNA, 25 bp, Rattus norvegicus
ttggtggtcagcactgctttgcaca

SEQ ID NO: 683290 - DNA, 25 bp, Rattus norvegicus
ttggtggtcagctctgctttgcaca

SEQ ID NO: 683291 - DNA, 25 bp, Rattus norvegicus
ttggtggtcatgatccctctgggaa

SEQ ID NO: 683292 - DNA, 25 bp, Rattus norvegicus
ttggtggtcatgttccctctgggaa

SEQ ID NO: 683293 - DNA, 25 bp, Rattus norvegicus
ttggtggtccatacagcttaagtga

SEQ ID NO: 683294 - DNA, 25 bp, Rattus norvegicus
ttggtggtccattcagcttaagtga

SEQ ID NO: 683295 - DNA, 25 bp, Rattus norvegicus
ttggtggtcggaatgtacgctgcta

SEQ ID NO: 683296 - DNA, 25 bp, Rattus norvegicus
ttggtggtcggattgtacgctgcta

SEQ ID NO: 683297 - DNA, 25 bp, Rattus norvegicus
ttggtggtgtacattccactgacct

SEQ ID NO: 683298 - DNA, 25 bp, Rattus norvegicus
ttggtggtgtactttccactgacct

SEQ ID NO: 683299 - DNA, 25 bp, Rattus norvegicus
ttggtggttcataattttatctctt

SEQ ID NO: 683300 - DNA, 25 bp, Rattus norvegicus
ttggtggttcattattttatctctt

SEQ ID NO: 683301 - DNA, 25 bp, Rattus norvegicus
ttggtggtttatatcttccgagtca

SEQ ID NO: 683302 - DNA, 25 bp, Rattus norvegicus
ttggtggtttatttcttccgagtca

SEQ ID NO: 683303 - DNA, 25 bp, Rattus norvegicus
ttggtgtacttgagctgggagctca

SEQ ID NO: 683304 - DNA, 25 bp, Rattus norvegicus
ttggtgtacttgcactcctcggcta

SEQ ID NO: 683305 - DNA, 25 bp, Rattus norvegicus
ttggtgtacttggactcctcggcta

SEQ ID NO: 683306 - DNA, 25 bp, Rattus norvegicus
ttggtgtacttgtgctgggagctca

SEQ ID NO: 683307 - DNA, 25 bp, Rattus norvegicus
ttggtgtaggcactcattggtcccc

SEQ ID NO: 683308 - DNA, 25 bp, Rattus norvegicus
ttggtgtaggcagtcattggtcccc

SEQ ID NO: 683309 - DNA, 25 bp, Rattus norvegicus
ttggtgtcaatgaagcccctgtgga

SEQ ID NO: 683310 - DNA, 25 bp, Rattus norvegicus
ttggtgtcaatgtagcccctgtgga

SEQ ID NO: 683311 - DNA, 25 bp, Rattus norvegicus
ttggtgtcacatctggctgttcact

SEQ ID NO: 683312 - DNA, 25 bp, Rattus norvegicus
ttggtgtcacatgtggctgttcact

SEQ ID NO: 683313 - DNA, 25 bp, Rattus norvegicus
ttggtgtcaccaactgggcaaaaaa

SEQ ID NO: 683314 - DNA, 25 bp, Rattus norvegicus
ttggtgtcaccatctgggcaaaaaa

SEQ ID NO: 683315 - DNA, 25 bp, Rattus norvegicus
ttggtgtcacggactgtgggcccta

SEQ ID NO: 683316 - DNA, 25 bp, Rattus norvegicus
ttggtgtcacggtctgtgggcccta

SEQ ID NO: 683317 - DNA, 25 bp, Rattus norvegicus
ttggtgtcagttactaaggccttca

SEQ ID NO: 683318 - DNA, 25 bp, Rattus norvegicus
ttggtgtcagtttctaaggccttca

SEQ ID NO: 683319 - DNA, 25 bp, Rattus norvegicus
ttggtgtccgcccagatcgcttcgc

SEQ ID NO: 683320 - DNA, 25 bp, Rattus norvegicus
ttggtgtccgccgagatcgcttcgc

SEQ ID NO: 683321 - DNA, 25 bp, Rattus norvegicus
ttggtgtccgcgactgttagaaaca

SEQ ID NO: 683322 - DNA, 25 bp, Rattus norvegicus
ttggtgtccgcgtctgttagaaaca

SEQ ID NO: 683323 - DNA, 25 bp, Rattus norvegicus
ttggtgtcctgtccagtggatttca

SEQ ID NO: 683324 - DNA, 25 bp, Rattus norvegicus
ttggtgtcctgtgcagtggatttca

SEQ ID NO: 683325 - DNA, 25 bp, Rattus norvegicus
ttggtgtcggagctcacagtttaca

SEQ ID NO: 683326 - DNA, 25 bp, Rattus norvegicus
ttggtgtcggaggtcacagtttaca

SEQ ID NO: 683327 - DNA, 25 bp, Rattus norvegicus
ttggtgtctgtgacctattcagttc

SEQ ID NO: 683328 - DNA, 25 bp, Rattus norvegicus
ttggtgtctgtgcacacacggcaaa

SEQ ID NO: 683329 - DNA, 25 bp, Rattus norvegicus
ttggtgtctgtggacacacggcaaa

SEQ ID NO: 683330 - DNA, 25 bp, Rattus norvegicus
ttggtgtctgtgtcctattcagttc

SEQ ID NO: 683331 - DNA, 25 bp, Rattus norvegicus
ttggtgtcttcaaagagtctcccca

SEQ ID NO: 683332 - DNA, 25 bp, Rattus norvegicus
ttggtgtcttcatagagtctcccca

SEQ ID NO: 683333 - DNA, 25 bp, Rattus norvegicus
ttggtgtcttgcatctgactctaac

SEQ ID NO: 683334 - DNA, 25 bp, Rattus norvegicus
ttggtgtcttgcttctgactctaac

SEQ ID NO: 683335 - DNA, 25 bp, Rattus norvegicus
ttggtgtgcagaaccacgacctaca

SEQ ID NO: 683336 - DNA, 25 bp, Rattus norvegicus
ttggtgtgcagatccacgacctaca

SEQ ID NO: 683337 - DNA, 25 bp, Rattus norvegicus
ttggtgtgcccaatagttttctttt

SEQ ID NO: 683338 - DNA, 25 bp, Rattus norvegicus
ttggtgtgcccattagttttctttt

SEQ ID NO: 683339 - DNA, 25 bp, Rattus norvegicus
ttggtgtgcctcacaagacttctcg

SEQ ID NO: 683340 - DNA, 25 bp, Rattus norvegicus
ttggtgtgcctctcaagacttctcg

SEQ ID NO: 683341 - DNA, 25 bp, Rattus norvegicus
ttggtgtgccttccggaacctcttt

SEQ ID NO: 683342 - DNA, 25 bp, Rattus norvegicus
ttggtgtgccttgcggaacctcttt

SEQ ID NO: 683343 - DNA, 25 bp, Rattus norvegicus
ttggtgtgcgacaatggctccggac

SEQ ID NO: 683344 - DNA, 25 bp, Rattus norvegicus
ttggtgtgcgactatggctccggac

SEQ ID NO: 683345 - DNA, 25 bp, Rattus norvegicus
ttggtgtgcggtcagacctcttctc

SEQ ID NO: 683346 - DNA, 25 bp, Rattus norvegicus
ttggtgtgcggtgagacctcttctc

SEQ ID NO: 683347 - DNA, 25 bp, Rattus norvegicus
ttggtgtgcttcactgttcgatgac

SEQ ID NO: 683348 - DNA, 25 bp, Rattus norvegicus
ttggtgtgcttctctgttcgatgac

SEQ ID NO: 683349 - DNA, 25 bp, Rattus norvegicus
ttggtgtggaggatttctcatcact

SEQ ID NO: 683350 - DNA, 25 bp, Rattus norvegicus
ttggtgtggaggttttctcatcact

SEQ ID NO: 683351 - DNA, 25 bp, Rattus norvegicus
ttggtgtggagtatgctttaagtgc

SEQ ID NO: 683352 - DNA, 25 bp, Rattus norvegicus
ttggtgtggagtttgctttaagtgc

SEQ ID NO: 683353 - DNA, 25 bp, Rattus norvegicus
ttggtgtgtagtcaatcccgtctct

SEQ ID NO: 683354 - DNA, 25 bp, Rattus norvegicus
ttggtgtgtagtgaatcccgtctct

SEQ ID NO: 683355 - DNA, 25 bp, Rattus norvegicus
ttggtgtgtgctccccgggttaact

SEQ ID NO: 683356 - DNA, 25 bp, Rattus norvegicus
ttggtgtgtgctgcccgggttaact

SEQ ID NO: 683357 - DNA, 25 bp, Rattus norvegicus
ttggtgttaccaaccctttcaagat

SEQ ID NO: 683358 - DNA, 25 bp, Rattus norvegicus
ttggtgttaccatccctttcaagat

SEQ ID NO: 683359 - DNA, 25 bp, Rattus norvegicus
ttggtgttactgacagcagcaccgc

SEQ ID NO: 683360 - DNA, 25 bp, Rattus norvegicus
ttggtgttactgtcagcagcaccgc

SEQ ID NO: 683361 - DNA, 25 bp, Rattus norvegicus
ttggtgttcatcacaggcctgtcat

SEQ ID NO: 683362 - DNA, 25 bp, Rattus norvegicus
ttggtgttcatctcaggcctgtcat

SEQ ID NO: 683363 - DNA, 25 bp, Rattus norvegicus
ttggtgttgaatcccaaaccggctc

SEQ ID NO: 683364 - DNA, 25 bp, Rattus norvegicus
ttggtgttgaatgccaaaccggctc

SEQ ID NO: 683365 - DNA, 25 bp, Rattus norvegicus
ttggtgtttcccaagtaccatgctc

SEQ ID NO: 683366 - DNA, 25 bp, Rattus norvegicus
ttggtgtttccctagtaccatgctc

SEQ ID NO: 683367 - DNA, 25 bp, Rattus norvegicus
ttggtgtttctacaactccccagag

SEQ ID NO: 683368 - DNA, 25 bp, Rattus norvegicus
ttggtgtttctagaactccccagag

SEQ ID NO: 683369 - DNA, 25 bp, Rattus norvegicus
ttggttagggccattgctgacccca

SEQ ID NO: 683370 - DNA, 25 bp, Rattus norvegicus
ttggttagggcctttgctgacccca

SEQ ID NO: 683371 - DNA, 25 bp, Rattus norvegicus
ttggttagtcccatggtgtctactc

SEQ ID NO: 683372 - DNA, 25 bp, Rattus norvegicus
ttggttagtcccttggtgtctactc

SEQ ID NO: 683373 - DNA, 25 bp, Rattus norvegicus
ttggttatccacatctagttttacg

SEQ ID NO: 683374 - DNA, 25 bp, Rattus norvegicus
ttggttatccacttctagttttacg

SEQ ID NO: 683375 - DNA, 25 bp, Rattus norvegicus
ttggttatcccacccatactggtac

SEQ ID NO: 683376 - DNA, 25 bp, Rattus norvegicus
ttggttatcccagccatactggtac

SEQ ID NO: 683377 - DNA, 25 bp, Rattus norvegicus
ttggttatcctaagcccttcgtttg

SEQ ID NO: 683378 - DNA, 25 bp, Rattus norvegicus
ttggttatcctatgcccttcgtttg

SEQ ID NO: 683379 - DNA, 25 bp, Rattus norvegicus
ttggttatgtctatgctctattgcc

SEQ ID NO: 683380 - DNA, 25 bp, Rattus norvegicus
ttggttatgtctttgctctattgcc

SEQ ID NO: 683381 - DNA, 25 bp, Rattus norvegicus
ttggttcaacctagggcacttaaca

SEQ ID NO: 683382 - DNA, 25 bp, Rattus norvegicus
ttggttcaaccttgggcacttaaca

SEQ ID NO: 683383 - DNA, 25 bp, Rattus norvegicus
ttggttcactgcacgttgggattcc

SEQ ID NO: 683384 - DNA, 25 bp, Rattus norvegicus
ttggttcactgctcgttgggattcc

SEQ ID NO: 683385 - DNA, 25 bp, Rattus norvegicus
ttggttcagcatatcctaactgtgc

SEQ ID NO: 683386 - DNA, 25 bp, Rattus norvegicus
ttggttcagcatttcctaactgtgc

SEQ ID NO: 683387 - DNA, 25 bp, Rattus norvegicus
ttggttcagcctcagtgatgcctca

SEQ ID NO: 683388 - DNA, 25 bp, Rattus norvegicus
ttggttcagcctgagtgatgcctca

SEQ ID NO: 683389 - DNA, 25 bp, Rattus norvegicus
ttggttcaggaaccccttagttcag

SEQ ID NO: 683390 - DNA, 25 bp, Rattus norvegicus
ttggttcaggaagcccttagttcag

SEQ ID NO: 683391 - DNA, 25 bp, Rattus norvegicus
ttggttcaggtcacacgactcagtc

SEQ ID NO: 683392 - DNA, 25 bp, Rattus norvegicus
ttggttcaggtcctttaggcagcca

SEQ ID NO: 683393 - DNA, 25 bp, Rattus norvegicus
ttggttcaggtcgtttaggcagcca

SEQ ID NO: 683394 - DNA, 25 bp, Rattus norvegicus
ttggttcaggtctcacgactcagtc

SEQ ID NO: 683395 - DNA, 25 bp, Rattus norvegicus
ttggttcattccaagcaagtactct

SEQ ID NO: 683396 - DNA, 25 bp, Rattus norvegicus
ttggttcattcctagcaagtactct

SEQ ID NO: 683397 - DNA, 25 bp, Rattus norvegicus
ttggttcattgcactagggacgttt

SEQ ID NO: 683398 - DNA, 25 bp, Rattus norvegicus
ttggttcattgctctagggacgttt

SEQ ID NO: 683399 - DNA, 25 bp, Rattus norvegicus
ttggttcattgtaaagtcctttgta

SEQ ID NO: 683400 - DNA, 25 bp, Rattus norvegicus
ttggttcattgttaagtcctttgta

SEQ ID NO: 683401 - DNA, 25 bp, Rattus norvegicus
ttggttccaggcattctggtgactt

SEQ ID NO: 683402 - DNA, 25 bp, Rattus norvegicus
ttggttccaggctttctggtgactt

SEQ ID NO: 683403 - DNA, 25 bp, Rattus norvegicus
ttggttccagtcatcattcagctgt

SEQ ID NO: 683404 - DNA, 25 bp, Rattus norvegicus
ttggttccagtcttcattcagctgt

SEQ ID NO: 683405 - DNA, 25 bp, Rattus norvegicus
ttggttccattgctattcttcagat

SEQ ID NO: 683406 - DNA, 25 bp, Rattus norvegicus
ttggttccattggtattcttcagat

SEQ ID NO: 683407 - DNA, 25 bp, Rattus norvegicus
ttggttcccaacactcacattgggt

SEQ ID NO: 683408 - DNA, 25 bp, Rattus norvegicus
ttggttcccaactctcacattgggt

SEQ ID NO: 683409 - DNA, 25 bp, Rattus norvegicus
ttggttcccttgcaatcttcttcta

SEQ ID NO: 683410 - DNA, 25 bp, Rattus norvegicus
ttggttcccttggaatcttcttcta

SEQ ID NO: 683411 - DNA, 25 bp, Rattus norvegicus
ttggttcctaacatgcctcccgcag

SEQ ID NO: 683412 - DNA, 25 bp, Rattus norvegicus
ttggttcctaacttgcctcccgcag

SEQ ID NO: 683413 - DNA, 25 bp, Rattus norvegicus
ttggttcctacaacgattgcccatg

SEQ ID NO: 683414 - DNA, 25 bp, Rattus norvegicus
ttggttcctacatcgattgcccatg

SEQ ID NO: 683415 - DNA, 25 bp, Rattus norvegicus
ttggttcctattagagccactttgc

SEQ ID NO: 683416 - DNA, 25 bp, Rattus norvegicus
ttggttcctatttgagccactttgc

SEQ ID NO: 683417 - DNA, 25 bp, Rattus norvegicus
ttggttcctgaaccgtgtgtaagga

SEQ ID NO: 683418 - DNA, 25 bp, Rattus norvegicus
ttggttcctgaagcgtgtgtaagga

SEQ ID NO: 683419 - DNA, 25 bp, Rattus norvegicus
ttggttcctggaagtgacaagccga

SEQ ID NO: 683420 - DNA, 25 bp, Rattus norvegicus
ttggttcctggatgtgacaagccga

SEQ ID NO: 683421 - DNA, 25 bp, Rattus norvegicus
ttggttcctgtcagtgatcttctag

SEQ ID NO: 683422 - DNA, 25 bp, Rattus norvegicus
ttggttcctgtctgtgatcttctag

SEQ ID NO: 683423 - DNA, 25 bp, Rattus norvegicus
ttggttcctgtgcatcttgggccgc

SEQ ID NO: 683424 - DNA, 25 bp, Rattus norvegicus
ttggttcctgtggatcttgggccgc

SEQ ID NO: 683425 - DNA, 25 bp, Rattus norvegicus
ttggttccttccctgggaccaggag

SEQ ID NO: 683426 - DNA, 25 bp, Rattus norvegicus
ttggttccttccgtgggaccaggag

SEQ ID NO: 683427 - DNA, 25 bp, Rattus norvegicus
ttggttctaatgcgctccaggatag

SEQ ID NO: 683428 - DNA, 25 bp, Rattus norvegicus
ttggttctaatgggctccaggatag

SEQ ID NO: 683429 - DNA, 25 bp, Rattus norvegicus
ttggttctaggtcttcagggaaagc

SEQ ID NO: 683430 - DNA, 25 bp, Rattus norvegicus
ttggttctaggtgttcagggaaagc

SEQ ID NO: 683431 - DNA, 25 bp, Rattus norvegicus
ttggttctatgtcacttggtttgga

SEQ ID NO: 683432 - DNA, 25 bp, Rattus norvegicus
ttggttctatgtgacttggtttgga

SEQ ID NO: 683433 - DNA, 25 bp, Rattus norvegicus
ttggttctattcatttacctccagg

SEQ ID NO: 683434 - DNA, 25 bp, Rattus norvegicus
ttggttctattcttttacctccagg

SEQ ID NO: 683435 - DNA, 25 bp, Rattus norvegicus
ttggttctcagaacgatgtctgtca

SEQ ID NO: 683436 - DNA, 25 bp, Rattus norvegicus
ttggttctcagatcgatgtctgtca

SEQ ID NO: 683437 - DNA, 25 bp, Rattus norvegicus
ttggttctcaggcttttgcacaaaa

SEQ ID NO: 683438 - DNA, 25 bp, Rattus norvegicus
ttggttctcagggttttgcacaaaa

SEQ ID NO: 683439 - DNA, 25 bp, Rattus norvegicus
ttggttctgtttatcatagcctcct

SEQ ID NO: 683440 - DNA, 25 bp, Rattus norvegicus
ttggttctgtttttcatagcctcct

SEQ ID NO: 683441 - DNA, 25 bp, Rattus norvegicus
ttggttcttaatcctgcggctttac

SEQ ID NO: 683442 - DNA, 25 bp, Rattus norvegicus
ttggttcttaatgctgcggctttac

SEQ ID NO: 683443 - DNA, 25 bp, Rattus norvegicus
ttggttcttgaaactgagttgtttc

SEQ ID NO: 683444 - DNA, 25 bp, Rattus norvegicus
ttggttcttgaatctgagttgtttc

SEQ ID NO: 683445 - DNA, 25 bp, Rattus norvegicus
ttggttcttggcacattcccacgct

SEQ ID NO: 683446 - DNA, 25 bp, Rattus norvegicus
ttggttcttggctcattcccacgct

SEQ ID NO: 683447 - DNA, 25 bp, Rattus norvegicus
ttggttgaaccccagagtttccata

SEQ ID NO: 683448 - DNA, 25 bp, Rattus norvegicus
ttggttgaacccgagagtttccata

SEQ ID NO: 683449 - DNA, 25 bp, Rattus norvegicus
ttggttgcaagacgttcagctgatg

SEQ ID NO: 683450 - DNA, 25 bp, Rattus norvegicus
ttggttgcaagaggttcagctgatg

SEQ ID NO: 683451 - DNA, 25 bp, Rattus norvegicus
ttggttgccacgagttatgtcccta

SEQ ID NO: 683452 - DNA, 25 bp, Rattus norvegicus
ttggttgccacgtgttatgtcccta

SEQ ID NO: 683453 - DNA, 25 bp, Rattus norvegicus
ttggttgcccaacgactgtagagga

SEQ ID NO: 683454 - DNA, 25 bp, Rattus norvegicus
ttggttgcccaaggactgtagagga

SEQ ID NO: 683455 - DNA, 25 bp, Rattus norvegicus
ttggttgctcagaagctagcaggaa

SEQ ID NO: 683456 - DNA, 25 bp, Rattus norvegicus
ttggttgctcagtagctagcaggaa

SEQ ID NO: 683457 - DNA, 25 bp, Rattus norvegicus
ttggttgctcgaactcttggtaaat

SEQ ID NO: 683458 - DNA, 25 bp, Rattus norvegicus
ttggttgctcgatctcttggtaaat

SEQ ID NO: 683459 - DNA, 25 bp, Rattus norvegicus
ttggttgctggaaaactgccacgtt

SEQ ID NO: 683460 - DNA, 25 bp, Rattus norvegicus
ttggttgctggataactgccacgtt

SEQ ID NO: 683461 - DNA, 25 bp, Rattus norvegicus
ttggttgctgttccagaagacccag

SEQ ID NO: 683462 - DNA, 25 bp, Rattus norvegicus
ttggttgctgttgcagaagacccag

SEQ ID NO: 683463 - DNA, 25 bp, Rattus norvegicus
ttggttgcttatatattcgtttgtc

SEQ ID NO: 683464 - DNA, 25 bp, Rattus norvegicus
ttggttgcttatttattcgtttgtc

SEQ ID NO: 683465 - DNA, 25 bp, Rattus norvegicus
ttggttgctttgctcaccgtgtagc

SEQ ID NO: 683466 - DNA, 25 bp, Rattus norvegicus
ttggttgctttggtcaccgtgtagc

SEQ ID NO: 683467 - DNA, 25 bp, Rattus norvegicus
ttggttggatgcctctttacccatg

SEQ ID NO: 683468 - DNA, 25 bp, Rattus norvegicus
ttggttggatgcgtctttacccatg

SEQ ID NO: 683469 - DNA, 25 bp, Rattus norvegicus
ttggttggcgccatgattacttttt

SEQ ID NO: 683470 - DNA, 25 bp, Rattus norvegicus
ttggttggcgccttgattacttttt

SEQ ID NO: 683471 - DNA, 25 bp, Rattus norvegicus
ttggttgggaccagggaacagtctc

SEQ ID NO: 683472 - DNA, 25 bp, Rattus norvegicus
ttggttgggacctgggaacagtctc

SEQ ID NO: 683473 - DNA, 25 bp, Rattus norvegicus
ttggttggtgctatgcgtggcaata

SEQ ID NO: 683474 - DNA, 25 bp, Rattus norvegicus
ttggttggtgctttgcgtggcaata

SEQ ID NO: 683475 - DNA, 25 bp, Rattus norvegicus
ttggttgtccctaatttccttgaat

SEQ ID NO: 683476 - DNA, 25 bp, Rattus norvegicus
ttggttgtcccttatttccttgaat

SEQ ID NO: 683477 - DNA, 25 bp, Rattus norvegicus
ttggttgtccttctctagtgtatat

SEQ ID NO: 683478 - DNA, 25 bp, Rattus norvegicus
ttggttgtccttgtctagtgtatat

SEQ ID NO: 683479 - DNA, 25 bp, Rattus norvegicus
ttggttgtctgcatttatctttctt

SEQ ID NO: 683480 - DNA, 25 bp, Rattus norvegicus
ttggttgtctgcttttatctttctt

SEQ ID NO: 683481 - DNA, 25 bp, Rattus norvegicus
ttggtttacccacctacaccgactg

SEQ ID NO: 683482 - DNA, 25 bp, Rattus norvegicus
ttggtttacccagctacaccgactg

SEQ ID NO: 683483 - DNA, 25 bp, Rattus norvegicus
ttggtttactcaacccatgtatgga

SEQ ID NO: 683484 - DNA, 25 bp, Rattus norvegicus
ttggtttactcatcccatgtatgga

SEQ ID NO: 683485 - DNA, 25 bp, Rattus norvegicus
ttggtttactgtccttcactcattc

SEQ ID NO: 683486 - DNA, 25 bp, Rattus norvegicus
ttggtttactgtgcttcactcattc

SEQ ID NO: 683487 - DNA, 25 bp, Rattus norvegicus
ttggtttaggctatggttcttgttg

SEQ ID NO: 683488 - DNA, 25 bp, Rattus norvegicus
ttggtttaggctttggttcttgttg

SEQ ID NO: 683489 - DNA, 25 bp, Rattus norvegicus
ttggtttagggacctgttgcctctc

SEQ ID NO: 683490 - DNA, 25 bp, Rattus norvegicus
ttggtttagggagctgttgcctctc

SEQ ID NO: 683491 - DNA, 25 bp, Rattus norvegicus
ttggtttattgtcccacccctagct

SEQ ID NO: 683492 - DNA, 25 bp, Rattus norvegicus
ttggtttattgtgccacccctagct

SEQ ID NO: 683493 - DNA, 25 bp, Rattus norvegicus
ttggtttcagaaaggctgtgcccca

SEQ ID NO: 683494 - DNA, 25 bp, Rattus norvegicus
ttggtttcagaatggctgtgcccca

SEQ ID NO: 683495 - DNA, 25 bp, Rattus norvegicus
ttggtttcagccagtggatgtccac

SEQ ID NO: 683496 - DNA, 25 bp, Rattus norvegicus
ttggtttcagcctgtggatgtccac

SEQ ID NO: 683497 - DNA, 25 bp, Rattus norvegicus
ttggtttccagcaggtgctgcagaa

SEQ ID NO: 683498 - DNA, 25 bp, Rattus norvegicus
ttggtttccagctggtgctgcagaa

SEQ ID NO: 683499 - DNA, 25 bp, Rattus norvegicus
ttggtttcccatcgcacacggtagt

SEQ ID NO: 683500 - DNA, 25 bp, Rattus norvegicus
ttggtttcccatggcacacggtagt

SEQ ID NO: 683501 - DNA, 25 bp, Rattus norvegicus
ttggtttccctgcagacaacagtgc

SEQ ID NO: 683502 - DNA, 25 bp, Rattus norvegicus
ttggtttccctggagacaacagtgc

SEQ ID NO: 683503 - DNA, 25 bp, Rattus norvegicus
ttggtttccggtaacctcacaatgc

SEQ ID NO: 683504 - DNA, 25 bp, Rattus norvegicus
ttggtttccggttacctcacaatgc

SEQ ID NO: 683505 - DNA, 25 bp, Rattus norvegicus
ttggtttctacgatggaggttcaca

SEQ ID NO: 683506 - DNA, 25 bp, Rattus norvegicus
ttggtttctacgttggaggttcaca

SEQ ID NO: 683507 - DNA, 25 bp, Rattus norvegicus
ttggtttctattccctttctaactg

SEQ ID NO: 683508 - DNA, 25 bp, Rattus norvegicus
ttggtttctattgcctttctaactg

SEQ ID NO: 683509 - DNA, 25 bp, Rattus norvegicus
ttggtttctggacccttgaagccca

SEQ ID NO: 683510 - DNA, 25 bp, Rattus norvegicus
ttggtttctggagccttgaagccca

SEQ ID NO: 683511 - DNA, 25 bp, Rattus norvegicus
ttggtttctgtgctcccatggagta

SEQ ID NO: 683512 - DNA, 25 bp, Rattus norvegicus
ttggtttctgtggtcccatggagta

SEQ ID NO: 683513 - DNA, 25 bp, Rattus norvegicus
ttggtttctttgatcagtgtcctgg

SEQ ID NO: 683514 - DNA, 25 bp, Rattus norvegicus
ttggtttctttgatgctcgggaatt

SEQ ID NO: 683515 - DNA, 25 bp, Rattus norvegicus
ttggtttctttgttcagtgtcctgg

SEQ ID NO: 683516 - DNA, 25 bp, Rattus norvegicus
ttggtttctttgttgctcgggaatt

SEQ ID NO: 683517 - DNA, 25 bp, Rattus norvegicus
ttggtttgcccaaaagcccatttat

SEQ ID NO: 683518 - DNA, 25 bp, Rattus norvegicus
ttggtttgcccataagcccatttat

SEQ ID NO: 683519 - DNA, 25 bp, Rattus norvegicus
ttggtttgctgtcacctcaatccca

SEQ ID NO: 683520 - DNA, 25 bp, Rattus norvegicus
ttggtttgctgtgacctcaatccca

SEQ ID NO: 683521 - DNA, 25 bp, Rattus norvegicus
ttggtttgggctagatttccagctc

SEQ ID NO: 683522 - DNA, 25 bp, Rattus norvegicus
ttggtttgggcttgatttccagctc

SEQ ID NO: 683523 - DNA, 25 bp, Rattus norvegicus
ttggtttgtgccaaccttctgttca

SEQ ID NO: 683524 - DNA, 25 bp, Rattus norvegicus
ttggtttgtgcctaccttctgttca

SEQ ID NO: 683525 - DNA, 25 bp, Rattus norvegicus
ttggtttgtgttcaaggccagtctc

SEQ ID NO: 683526 - DNA, 25 bp, Rattus norvegicus
ttggtttgtgttgaaggccagtctc

SEQ ID NO: 683527 - DNA, 25 bp, Rattus norvegicus
ttggttttactgaagcttgctcgcc

SEQ ID NO: 683528 - DNA, 25 bp, Rattus norvegicus
ttggttttactgtagcttgctcgcc

SEQ ID NO: 683529 - DNA, 25 bp, Rattus norvegicus
ttggttttatttaggctctagctaa

SEQ ID NO: 683530 - DNA, 25 bp, Rattus norvegicus
ttggttttattttggctctagctaa

SEQ ID NO: 683531 - DNA, 25 bp, Rattus norvegicus
ttggttttcaagacaactagcttag

SEQ ID NO: 683532 - DNA, 25 bp, Rattus norvegicus
ttggttttcaagtcaactagcttag

SEQ ID NO: 683533 - DNA, 25 bp, Rattus norvegicus
ttggttttcaggaccatgtcaccgt

SEQ ID NO: 683534 - DNA, 25 bp, Rattus norvegicus
ttggttttcaggtccatgtcaccgt

SEQ ID NO: 683535 - DNA, 25 bp, Rattus norvegicus
ttggttttcccgagacaggctacag

SEQ ID NO: 683536 - DNA, 25 bp, Rattus norvegicus
ttggttttcccgtgacaggctacag

SEQ ID NO: 683537 - DNA, 25 bp, Rattus norvegicus
ttggttttcgtgctgctgagaactc

SEQ ID NO: 683538 - DNA, 25 bp, Rattus norvegicus
ttggttttcgtggtgctgagaactc

SEQ ID NO: 683539 - DNA, 25 bp, Rattus norvegicus
ttggttttctctatattcttctctg

SEQ ID NO: 683540 - DNA, 25 bp, Rattus norvegicus
ttggttttctctttattcttctctg

SEQ ID NO: 683541 - DNA, 25 bp, Rattus norvegicus
ttggttttgcggacagccttacaga

SEQ ID NO: 683542 - DNA, 25 bp, Rattus norvegicus
ttggttttgcggtcagccttacaga

SEQ ID NO: 683543 - DNA, 25 bp, Rattus norvegicus
ttggttttgtgtaacaggagtttct

SEQ ID NO: 683544 - DNA, 25 bp, Rattus norvegicus
ttggttttgtgttacaggagtttct

SEQ ID NO: 683545 - DNA, 25 bp, Rattus norvegicus
ttggtttttcctactactctaatct

SEQ ID NO: 683546 - DNA, 25 bp, Rattus norvegicus
ttggtttttccttctactctaatct

SEQ ID NO: 683547 - DNA, 25 bp, Rattus norvegicus
ttggtttttctacccgagtgttggg

SEQ ID NO: 683548 - DNA, 25 bp, Rattus norvegicus
ttggtttttctagccgagtgttggg

SEQ ID NO: 683549 - DNA, 25 bp, Rattus norvegicus
ttggtttttggtacattttgagaca

SEQ ID NO: 683550 - DNA, 25 bp, Rattus norvegicus
ttggtttttggttcattttgagaca

SEQ ID NO: 683551 - DNA, 25 bp, Rattus norvegicus
ttggttttttgaagatggccccgaa

SEQ ID NO: 683552 - DNA, 25 bp, Rattus norvegicus
ttggttttttgatgatggccccgaa

SEQ ID NO: 683553 - DNA, 25 bp, Rattus norvegicus
ttgtaaaacctgagctatctttcca

SEQ ID NO: 683554 - DNA, 25 bp, Rattus norvegicus
ttgtaaaacctgtgctatctttcca

SEQ ID NO: 683555 - DNA, 25 bp, Rattus norvegicus
ttgtaaaagtgcacgtctccgcgta

SEQ ID NO: 683556 - DNA, 25 bp, Rattus norvegicus
ttgtaaaagtgctcgtctccgcgta

SEQ ID NO: 683557 - DNA, 25 bp, Rattus norvegicus
ttgtaaacacataccttttccatac

SEQ ID NO: 683558 - DNA, 25 bp, Rattus norvegicus
ttgtaaacacattccttttccatac

SEQ ID NO: 683559 - DNA, 25 bp, Rattus norvegicus
ttgtaaaccagacccgccgagagtg

SEQ ID NO: 683560 - DNA, 25 bp, Rattus norvegicus
ttgtaaaccagagccgccgagagtg

SEQ ID NO: 683561 - DNA, 25 bp, Rattus norvegicus
ttgtaaacctgcactaaacctctca

SEQ ID NO: 683562 - DNA, 25 bp, Rattus norvegicus
ttgtaaacctgctctaaacctctca

SEQ ID NO: 683563 - DNA, 25 bp, Rattus norvegicus
ttgtaaactagccactcagtgctgg

SEQ ID NO: 683564 - DNA, 25 bp, Rattus norvegicus
ttgtaaactagcgactcagtgctgg

SEQ ID NO: 683565 - DNA, 25 bp, Rattus norvegicus
ttgtaaactctcacagaccaaacgt

SEQ ID NO: 683566 - DNA, 25 bp, Rattus norvegicus
ttgtaaactctctcagaccaaacgt

SEQ ID NO: 683567 - DNA, 25 bp, Rattus norvegicus
ttgtaaaggcgcctcttcagtcaac

SEQ ID NO: 683568 - DNA, 25 bp, Rattus norvegicus
ttgtaaaggcgcgtcttcagtcaac

SEQ ID NO: 683569 - DNA, 25 bp, Rattus norvegicus
ttgtaaagggctcgtcacctgtgga

SEQ ID NO: 683570 - DNA, 25 bp, Rattus norvegicus
ttgtaaagggctggtcacctgtgga

SEQ ID NO: 683571 - DNA, 25 bp, Rattus norvegicus
ttgtaaagtctgaagcttctcccca

SEQ ID NO: 683572 - DNA, 25 bp, Rattus norvegicus
ttgtaaagtctgtagcttctcccca

SEQ ID NO: 683573 - DNA, 25 bp, Rattus norvegicus
ttgtaaagtgacacaccctccgttt

SEQ ID NO: 683574 - DNA, 25 bp, Rattus norvegicus
ttgtaaagtgaccttcctcttcctt

SEQ ID NO: 683575 - DNA, 25 bp, Rattus norvegicus
ttgtaaagtgacgttcctcttcctt

SEQ ID NO: 683576 - DNA, 25 bp, Rattus norvegicus
ttgtaaagtgactcaccctccgttt

SEQ ID NO: 683577 - DNA, 25 bp, Rattus norvegicus
ttgtaaataacacttccccagacct

SEQ ID NO: 683578 - DNA, 25 bp, Rattus norvegicus
ttgtaaataacagttccccagacct

SEQ ID NO: 683579 - DNA, 25 bp, Rattus norvegicus
ttgtaaatagaaccagcccagcccg

SEQ ID NO: 683580 - DNA, 25 bp, Rattus norvegicus
ttgtaaatagaagcagcccagcccg

SEQ ID NO: 683581 - DNA, 25 bp, Rattus norvegicus
ttgtaaatagctacccagttggttt

SEQ ID NO: 683582 - DNA, 25 bp, Rattus norvegicus
ttgtaaatagcttcccagttggttt

SEQ ID NO: 683583 - DNA, 25 bp, Rattus norvegicus
ttgtaaatcattagctgccaccagc

SEQ ID NO: 683584 - DNA, 25 bp, Rattus norvegicus
ttgtaaatcatttgctgccaccagc

SEQ ID NO: 683585 - DNA, 25 bp, Rattus norvegicus
ttgtaaatcgcacccagtggactgc

SEQ ID NO: 683586 - DNA, 25 bp, Rattus norvegicus
ttgtaaatcgcagccagtggactgc

SEQ ID NO: 683587 - DNA, 25 bp, Rattus norvegicus
ttgtaaatgctcactccccttctgg

SEQ ID NO: 683588 - DNA, 25 bp, Rattus norvegicus
ttgtaaatgctctctccccttctgg

SEQ ID NO: 683589 - DNA, 25 bp, Rattus norvegicus
ttgtaaatgtatcttggtgctgctg

SEQ ID NO: 683590 - DNA, 25 bp, Rattus norvegicus
ttgtaaatgtatgttggtgctgctg

SEQ ID NO: 683591 - DNA, 25 bp, Rattus norvegicus
ttgtaaatttccaggctttctctgg

SEQ ID NO: 683592 - DNA, 25 bp, Rattus norvegicus
ttgtaaatttcctggctttctctgg

SEQ ID NO: 683593 - DNA, 25 bp, Rattus norvegicus
ttgtaacaacctaccactctagtgt

SEQ ID NO: 683594 - DNA, 25 bp, Rattus norvegicus
ttgtaacaaccttccactctagtgt

SEQ ID NO: 683595 - DNA, 25 bp, Rattus norvegicus
ttgtaacaaggacacctaccttcct

SEQ ID NO: 683596 - DNA, 25 bp, Rattus norvegicus
ttgtaacaaggagacctaccttcct

SEQ ID NO: 683597 - DNA, 25 bp, Rattus norvegicus
ttgtaacacagactggtgcctgggt

SEQ ID NO: 683598 - DNA, 25 bp, Rattus norvegicus
ttgtaacacagagtggtgcctgggt

SEQ ID NO: 683599 - DNA, 25 bp, Rattus norvegicus
ttgtaacaccaacggcttctaccaa

SEQ ID NO: 683600 - DNA, 25 bp, Rattus norvegicus
ttgtaacaccaagggcttctaccaa

SEQ ID NO: 683601 - DNA, 25 bp, Rattus norvegicus
ttgtaacacttacctcgtgagggct

SEQ ID NO: 683602 - DNA, 25 bp, Rattus norvegicus
ttgtaacacttagctcgtgagggct

SEQ ID NO: 683603 - DNA, 25 bp, Rattus norvegicus
ttgtaacagctcatttctcacgcag

SEQ ID NO: 683604 - DNA, 25 bp, Rattus norvegicus
ttgtaacagctcttttctcacgcag

SEQ ID NO: 683605 - DNA, 25 bp, Rattus norvegicus
ttgtaacatatcaagccctggaggc

SEQ ID NO: 683606 - DNA, 25 bp, Rattus norvegicus
ttgtaacatatctagccctggaggc

SEQ ID NO: 683607 - DNA, 25 bp, Rattus norvegicus
ttgtaacatggcatcgagtgggtct

SEQ ID NO: 683608 - DNA, 25 bp, Rattus norvegicus
ttgtaacatggcttcgagtgggtct

SEQ ID NO: 683609 - DNA, 25 bp, Rattus norvegicus
ttgtaacatgtaatctccctctcac

SEQ ID NO: 683610 - DNA, 25 bp, Rattus norvegicus
ttgtaacatgtattctccctctcac

SEQ ID NO: 683611 - DNA, 25 bp, Rattus norvegicus
ttgtaaccaacactcacttaggctg

SEQ ID NO: 683612 - DNA, 25 bp, Rattus norvegicus
ttgtaaccaacagtcacttaggctg

SEQ ID NO: 683613 - DNA, 25 bp, Rattus norvegicus
ttgtaaccacaaaaatcttggaatg

SEQ ID NO: 683614 - DNA, 25 bp, Rattus norvegicus
ttgtaaccacaataatcttggaatg

SEQ ID NO: 683615 - DNA, 25 bp, Rattus norvegicus
ttgtaaccactgaattcatagctag

SEQ ID NO: 683616 - DNA, 25 bp, Rattus norvegicus
ttgtaaccactgtattcatagctag

SEQ ID NO: 683617 - DNA, 25 bp, Rattus norvegicus
ttgtaaccagccaggcacctacagt

SEQ ID NO: 683618 - DNA, 25 bp, Rattus norvegicus
ttgtaaccagcctggcacctacagt

SEQ ID NO: 683619 - DNA, 25 bp, Rattus norvegicus
ttgtaaccccatcagtggctctcat

SEQ ID NO: 683620 - DNA, 25 bp, Rattus norvegicus
ttgtaaccccatgagtggctctcat

SEQ ID NO: 683621 - DNA, 25 bp, Rattus norvegicus
ttgtaaccccttatctctggaatta

SEQ ID NO: 683622 - DNA, 25 bp, Rattus norvegicus
ttgtaaccccttcctagtactcagt

SEQ ID NO: 683623 - DNA, 25 bp, Rattus norvegicus
ttgtaaccccttgctagtactcagt

SEQ ID NO: 683624 - DNA, 25 bp, Rattus norvegicus
ttgtaaccccttttctctggaatta

SEQ ID NO: 683625 - DNA, 25 bp, Rattus norvegicus
ttgtaacctccacaggtactgcatg

SEQ ID NO: 683626 - DNA, 25 bp, Rattus norvegicus
ttgtaacctccagaggtactgcatg

SEQ ID NO: 683627 - DNA, 25 bp, Rattus norvegicus
ttgtaacgataaacttctccccttg

SEQ ID NO: 683628 - DNA, 25 bp, Rattus norvegicus
ttgtaacgataatcttctccccttg

SEQ ID NO: 683629 - DNA, 25 bp, Rattus norvegicus
ttgtaacgccaaccccaagggattg

SEQ ID NO: 683630 - DNA, 25 bp, Rattus norvegicus
ttgtaacgccaagcccaagggattg

SEQ ID NO: 683631 - DNA, 25 bp, Rattus norvegicus
ttgtaacggtgtcccctaccagaca

SEQ ID NO: 683632 - DNA, 25 bp, Rattus norvegicus
ttgtaacggtgtgccctaccagaca

SEQ ID NO: 683633 - DNA, 25 bp, Rattus norvegicus
ttgtaactaaagcaatcccctcact

SEQ ID NO: 683634 - DNA, 25 bp, Rattus norvegicus
ttgtaactaaaggaatcccctcact

SEQ ID NO: 683635 - DNA, 25 bp, Rattus norvegicus
ttgtaactacatacccctctaaata

SEQ ID NO: 683636 - DNA, 25 bp, Rattus norvegicus
ttgtaactacattcccctctaaata

SEQ ID NO: 683637 - DNA, 25 bp, Rattus norvegicus
ttgtaactaggaagccctctttggc

SEQ ID NO: 683638 - DNA, 25 bp, Rattus norvegicus
ttgtaactaggatgccctctttggc

SEQ ID NO: 683639 - DNA, 25 bp, Rattus norvegicus
ttgtaactcgagaccagagctggcc

SEQ ID NO: 683640 - DNA, 25 bp, Rattus norvegicus
ttgtaactcgagtccagagctggcc

SEQ ID NO: 683641 - DNA, 25 bp, Rattus norvegicus
ttgtaactgcatcgccacagtaaaa

SEQ ID NO: 683642 - DNA, 25 bp, Rattus norvegicus
ttgtaactgcatcgcttaacctggt

SEQ ID NO: 683643 - DNA, 25 bp, Rattus norvegicus
ttgtaactgcatggccacagtaaaa

SEQ ID NO: 683644 - DNA, 25 bp, Rattus norvegicus
ttgtaactgcatggcttaacctggt

SEQ ID NO: 683645 - DNA, 25 bp, Rattus norvegicus
ttgtaactggcacggttttgtttgt

SEQ ID NO: 683646 - DNA, 25 bp, Rattus norvegicus
ttgtaactggcagggttttgtttgt

SEQ ID NO: 683647 - DNA, 25 bp, Rattus norvegicus
ttgtaactgtctcagagcagcccta

SEQ ID NO: 683648 - DNA, 25 bp, Rattus norvegicus
ttgtaactgtctgagagcagcccta

SEQ ID NO: 683649 - DNA, 25 bp, Rattus norvegicus
ttgtaacttcagctccagggatcta

SEQ ID NO: 683650 - DNA, 25 bp, Rattus norvegicus
ttgtaacttcaggtccagggatcta

SEQ ID NO: 683651 - DNA, 25 bp, Rattus norvegicus
ttgtaacttgttactggcctagggt

SEQ ID NO: 683652 - DNA, 25 bp, Rattus norvegicus
ttgtaacttgtttctggcctagggt

SEQ ID NO: 683653 - DNA, 25 bp, Rattus norvegicus
ttgtaactttctaatgactcttgga

SEQ ID NO: 683654 - DNA, 25 bp, Rattus norvegicus
ttgtaactttcttatgactcttgga

SEQ ID NO: 683655 - DNA, 25 bp, Rattus norvegicus
ttgtaagacaatcttctgcctgcct

SEQ ID NO: 683656 - DNA, 25 bp, Rattus norvegicus
ttgtaagacaatgttctgcctgcct

SEQ ID NO: 683657 - DNA, 25 bp, Rattus norvegicus
ttgtaagatttgaccagctattgct

SEQ ID NO: 683658 - DNA, 25 bp, Rattus norvegicus
ttgtaagatttgtccagctattgct

SEQ ID NO: 683659 - DNA, 25 bp, Rattus norvegicus
ttgtaagcacagatgccccttttca

SEQ ID NO: 683660 - DNA, 25 bp, Rattus norvegicus
ttgtaagcacagttgccccttttca

SEQ ID NO: 683661 - DNA, 25 bp, Rattus norvegicus
ttgtaagcagcgatcctgtctaacc

SEQ ID NO: 683662 - DNA, 25 bp, Rattus norvegicus
ttgtaagcagcgttcctgtctaacc

SEQ ID NO: 683663 - DNA, 25 bp, Rattus norvegicus
ttgtaagcatcgagcggcttttctt

SEQ ID NO: 683664 - DNA, 25 bp, Rattus norvegicus
ttgtaagcatcgtgcggcttttctt

SEQ ID NO: 683665 - DNA, 25 bp, Rattus norvegicus
ttgtaagccttcatgtcactgtaac

SEQ ID NO: 683666 - DNA, 25 bp, Rattus norvegicus
ttgtaagccttcttgtcactgtaac

SEQ ID NO: 683667 - DNA, 25 bp, Rattus norvegicus
ttgtaagctccacaatgggcgcctt

SEQ ID NO: 683668 - DNA, 25 bp, Rattus norvegicus
ttgtaagctccagaatgggcgcctt

SEQ ID NO: 683669 - DNA, 25 bp, Rattus norvegicus
ttgtaagctttccatggtgctgtcc

SEQ ID NO: 683670 - DNA, 25 bp, Rattus norvegicus
ttgtaagctttcgatggtgctgtcc

SEQ ID NO: 683671 - DNA, 25 bp, Rattus norvegicus
ttgtaaggcaagcactgttacccac

SEQ ID NO: 683672 - DNA, 25 bp, Rattus norvegicus
ttgtaaggcaaggactgttacccac

SEQ ID NO: 683673 - DNA, 25 bp, Rattus norvegicus
ttgtaagtgcaaagacccgagtcct

SEQ ID NO: 683674 - DNA, 25 bp, Rattus norvegicus
ttgtaagtgcaatgacccgagtcct

SEQ ID NO: 683675 - DNA, 25 bp, Rattus norvegicus
ttgtaagtgcacaaactcctgctcc

SEQ ID NO: 683676 - DNA, 25 bp, Rattus norvegicus
ttgtaagtgcactaactcctgctcc

SEQ ID NO: 683677 - DNA, 25 bp, Rattus norvegicus
ttgtaagttcaaatctctgcatgtc

SEQ ID NO: 683678 - DNA, 25 bp, Rattus norvegicus
ttgtaagttcaattctctgcatgtc

SEQ ID NO: 683679 - DNA, 25 bp, Rattus norvegicus
ttgtaagttcctcggttttcttctg

SEQ ID NO: 683680 - DNA, 25 bp, Rattus norvegicus
ttgtaagttcctgggttttcttctg

SEQ ID NO: 683681 - DNA, 25 bp, Rattus norvegicus
ttgtaagtttttctgcttcgcatga

SEQ ID NO: 683682 - DNA, 25 bp, Rattus norvegicus
ttgtaagtttttgtgcttcgcatga

SEQ ID NO: 683683 - DNA, 25 bp, Rattus norvegicus
ttgtaatagcaacttccacgccatt

SEQ ID NO: 683684 - DNA, 25 bp, Rattus norvegicus
ttgtaatagcaagttccacgccatt

SEQ ID NO: 683685 - DNA, 25 bp, Rattus norvegicus
ttgtaatatggcagctggccttgct

SEQ ID NO: 683686 - DNA, 25 bp, Rattus norvegicus
ttgtaatatggctgctggccttgct

SEQ ID NO: 683687 - DNA, 25 bp, Rattus norvegicus
ttgtaatcccacaacttggaggctg

SEQ ID NO: 683688 - DNA, 25 bp, Rattus norvegicus
ttgtaatcccactacttggaggctg

SEQ ID NO: 683689 - DNA, 25 bp, Rattus norvegicus
ttgtaatcggtgctgtgttttcccc

SEQ ID NO: 683690 - DNA, 25 bp, Rattus norvegicus
ttgtaatcggtggtgtgttttcccc

SEQ ID NO: 683691 - DNA, 25 bp, Rattus norvegicus
ttgtaatctagccttgtcgcctgta

SEQ ID NO: 683692 - DNA, 25 bp, Rattus norvegicus
ttgtaatctagcgttgtcgcctgta

SEQ ID NO: 683693 - DNA, 25 bp, Rattus norvegicus
ttgtaatctctcaaggtgctctttg

SEQ ID NO: 683694 - DNA, 25 bp, Rattus norvegicus
ttgtaatctctctaggtgctctttg

SEQ ID NO: 683695 - DNA, 25 bp, Rattus norvegicus
ttgtaattcctccagctaacatttt

SEQ ID NO: 683696 - DNA, 25 bp, Rattus norvegicus
ttgtaattcctcgagctaacatttt

SEQ ID NO: 683697 - DNA, 25 bp, Rattus norvegicus
ttgtaattcctgatcttccgtcttt

SEQ ID NO: 683698 - DNA, 25 bp, Rattus norvegicus
ttgtaattcctgttcttccgtcttt

SEQ ID NO: 683699 - DNA, 25 bp, Rattus norvegicus
ttgtaattctagcatctgggaggca

SEQ ID NO: 683700 - DNA, 25 bp, Rattus norvegicus
ttgtaattctaggatctgggaggca

SEQ ID NO: 683701 - DNA, 25 bp, Rattus norvegicus
ttgtaatttaagagaccgtggtcct

SEQ ID NO: 683702 - DNA, 25 bp, Rattus norvegicus
ttgtaatttaagtgaccgtggtcct

SEQ ID NO: 683703 - DNA, 25 bp, Rattus norvegicus
ttgtacaaaactcacggtcctctct

SEQ ID NO: 683704 - DNA, 25 bp, Rattus norvegicus
ttgtacaaaactgacggtcctctct

SEQ ID NO: 683705 - DNA, 25 bp, Rattus norvegicus
ttgtacaaacaaatgccactactgt

SEQ ID NO: 683706 - DNA, 25 bp, Rattus norvegicus
ttgtacaaacaattgccactactgt

SEQ ID NO: 683707 - DNA, 25 bp, Rattus norvegicus
ttgtacaaagttaccaaatctctga

SEQ ID NO: 683708 - DNA, 25 bp, Rattus norvegicus
ttgtacaaagtttccaaatctctga

SEQ ID NO: 683709 - DNA, 25 bp, Rattus norvegicus
ttgtacaaatagctgacttcctgga

SEQ ID NO: 683710 - DNA, 25 bp, Rattus norvegicus
ttgtacaaataggtgacttcctgga

SEQ ID NO: 683711 - DNA, 25 bp, Rattus norvegicus
ttgtacaacatgctcttaataaaaa

SEQ ID NO: 683712 - DNA, 25 bp, Rattus norvegicus
ttgtacaacatggtcttaataaaaa

SEQ ID NO: 683713 - DNA, 25 bp, Rattus norvegicus
ttgtacaagtccaatctacgctgat

SEQ ID NO: 683714 - DNA, 25 bp, Rattus norvegicus
ttgtacaagtcctatctacgctgat

SEQ ID NO: 683715 - DNA, 25 bp, Rattus norvegicus
ttgtacaatggccttttcgttccaa

SEQ ID NO: 683716 - DNA, 25 bp, Rattus norvegicus
ttgtacaatggcgttttcgttccaa

SEQ ID NO: 683717 - DNA, 25 bp, Rattus norvegicus
ttgtacacaaccctgccactggaag

SEQ ID NO: 683718 - DNA, 25 bp, Rattus norvegicus
ttgtacacaaccgtgccactggaag

SEQ ID NO: 683719 - DNA, 25 bp, Rattus norvegicus
ttgtacacataaccagccaggccct

SEQ ID NO: 683720 - DNA, 25 bp, Rattus norvegicus
ttgtacacataagcagccaggccct

SEQ ID NO: 683721 - DNA, 25 bp, Rattus norvegicus
ttgtacacatcaaggcatgccacgg

SEQ ID NO: 683722 - DNA, 25 bp, Rattus norvegicus
ttgtacacatcatggcatgccacgg

SEQ ID NO: 683723 - DNA, 25 bp, Rattus norvegicus
ttgtacactgggacccctgttggtg

SEQ ID NO: 683724 - DNA, 25 bp, Rattus norvegicus
ttgtacactgggtcccctgttggtg

SEQ ID NO: 683725 - DNA, 25 bp, Rattus norvegicus
ttgtacactgtacacctcggtatct

SEQ ID NO: 683726 - DNA, 25 bp, Rattus norvegicus
ttgtacactgtagacctcggtatct

SEQ ID NO: 683727 - DNA, 25 bp, Rattus norvegicus
ttgtacagaagcagcagtccccaga

SEQ ID NO: 683728 - DNA, 25 bp, Rattus norvegicus
ttgtacagaagctgcagtccccaga

SEQ ID NO: 683729 - DNA, 25 bp, Rattus norvegicus
ttgtacaggcaaccacacccaagat

SEQ ID NO: 683730 - DNA, 25 bp, Rattus norvegicus
ttgtacaggcaagcacacccaagat

SEQ ID NO: 683731 - DNA, 25 bp, Rattus norvegicus
ttgtacataaataaagccctttcta

SEQ ID NO: 683732 - DNA, 25 bp, Rattus norvegicus
ttgtacataaattaagccctttcta

SEQ ID NO: 683733 - DNA, 25 bp, Rattus norvegicus
ttgtacatactcctggcccgcaaca

SEQ ID NO: 683734 - DNA, 25 bp, Rattus norvegicus
ttgtacatactcgtggcccgcaaca

SEQ ID NO: 683735 - DNA, 25 bp, Rattus norvegicus
ttgtacatagtcctttcctactctg

SEQ ID NO: 683736 - DNA, 25 bp, Rattus norvegicus
ttgtacatagtcgtttcctactctg

SEQ ID NO: 683737 - DNA, 25 bp, Rattus norvegicus
ttgtacatcaaacccctccattggg

SEQ ID NO: 683738 - DNA, 25 bp, Rattus norvegicus
ttgtacatcaaagccctccattggg

SEQ ID NO: 683739 - DNA, 25 bp, Rattus norvegicus
ttgtacatccatccgccgtgtgatt

SEQ ID NO: 683740 - DNA, 25 bp, Rattus norvegicus
ttgtacatccatgcgccgtgtgatt

SEQ ID NO: 683741 - DNA, 25 bp, Rattus norvegicus
ttgtacatctctccgttggcagagt

SEQ ID NO: 683742 - DNA, 25 bp, Rattus norvegicus
ttgtacatctctgcgttggcagagt

SEQ ID NO: 683743 - DNA, 25 bp, Rattus norvegicus
ttgtacatgaccagctctcccagtg

SEQ ID NO: 683744 - DNA, 25 bp, Rattus norvegicus
ttgtacatgacctgctctcccagtg

SEQ ID NO: 683745 - DNA, 25 bp, Rattus norvegicus
ttgtacatgatacccagccagagtc

SEQ ID NO: 683746 - DNA, 25 bp, Rattus norvegicus
ttgtacatgatagccagccagagtc

SEQ ID NO: 683747 - DNA, 25 bp, Rattus norvegicus
ttgtacatgatccaagcgttgtctt

SEQ ID NO: 683748 - DNA, 25 bp, Rattus norvegicus
ttgtacatgatcgaagcgttgtctt

SEQ ID NO: 683749 - DNA, 25 bp, Rattus norvegicus
ttgtacatgcagaggctactcttga

SEQ ID NO: 683750 - DNA, 25 bp, Rattus norvegicus
ttgtacatgcagtggctactcttga

SEQ ID NO: 683751 - DNA, 25 bp, Rattus norvegicus
ttgtacatgtgcagtgtgacaccac

SEQ ID NO: 683752 - DNA, 25 bp, Rattus norvegicus
ttgtacatgtgctgtgtgacaccac

SEQ ID NO: 683753 - DNA, 25 bp, Rattus norvegicus
ttgtaccaagaaagccgttcccaca

SEQ ID NO: 683754 - DNA, 25 bp, Rattus norvegicus
ttgtaccaagaatgccgttcccaca

SEQ ID NO: 683755 - DNA, 25 bp, Rattus norvegicus
ttgtaccagcgcctctgaacctgag

SEQ ID NO: 683756 - DNA, 25 bp, Rattus norvegicus
ttgtaccagcgcgtctgaacctgag

SEQ ID NO: 683757 - DNA, 25 bp, Rattus norvegicus
ttgtaccagggtatgcatcttcact

SEQ ID NO: 683758 - DNA, 25 bp, Rattus norvegicus
ttgtaccagggtttgcatcttcact

SEQ ID NO: 683759 - DNA, 25 bp, Rattus norvegicus
ttgtacccaaacacctagcaaattg

SEQ ID NO: 683760 - DNA, 25 bp, Rattus norvegicus
ttgtacccaaactcctagcaaattg

SEQ ID NO: 683761 - DNA, 25 bp, Rattus norvegicus
ttgtaccccagcactgcatattaat

SEQ ID NO: 683762 - DNA, 25 bp, Rattus norvegicus
ttgtaccccagctctgcatattaat

SEQ ID NO: 683763 - DNA, 25 bp, Rattus norvegicus
ttgtacccgcagacactacgaaagg

SEQ ID NO: 683764 - DNA, 25 bp, Rattus norvegicus
ttgtacccgcagtcactacgaaagg

SEQ ID NO: 683765 - DNA, 25 bp, Rattus norvegicus
ttgtacccgtggaagtccggcaggc

SEQ ID NO: 683766 - DNA, 25 bp, Rattus norvegicus
ttgtacccgtggtagtccggcaggc

SEQ ID NO: 683767 - DNA, 25 bp, Rattus norvegicus
ttgtacccttcgactggtacagggt

SEQ ID NO: 683768 - DNA, 25 bp, Rattus norvegicus
ttgtacccttcgtctggtacagggt

SEQ ID NO: 683769 - DNA, 25 bp, Rattus norvegicus
ttgtaccctttcactcttctaaaat

SEQ ID NO: 683770 - DNA, 25 bp, Rattus norvegicus
ttgtaccctttctctcttctaaaat

SEQ ID NO: 683771 - DNA, 25 bp, Rattus norvegicus
ttgtaccgtcatcttaattgccctg

SEQ ID NO: 683772 - DNA, 25 bp, Rattus norvegicus
ttgtaccgtcatgttaattgccctg

SEQ ID NO: 683773 - DNA, 25 bp, Rattus norvegicus
ttgtaccgtgatctgcatatcttgc

SEQ ID NO: 683774 - DNA, 25 bp, Rattus norvegicus
ttgtaccgtgatgtgcatatcttgc

SEQ ID NO: 683775 - DNA, 25 bp, Rattus norvegicus
ttgtaccgttgaccctacgatctag

SEQ ID NO: 683776 - DNA, 25 bp, Rattus norvegicus
ttgtaccgttgagcctacgatctag

SEQ ID NO: 683777 - DNA, 25 bp, Rattus norvegicus
ttgtacctaaaccatttgctatcgt

SEQ ID NO: 683778 - DNA, 25 bp, Rattus norvegicus
ttgtacctaaacgatttgctatcgt

SEQ ID NO: 683779 - DNA, 25 bp, Rattus norvegicus
ttgtacctaaggcagataccattgt

SEQ ID NO: 683780 - DNA, 25 bp, Rattus norvegicus
ttgtacctaagggagataccattgt

SEQ ID NO: 683781 - DNA, 25 bp, Rattus norvegicus
ttgtacctaagtcgatataaaagtt

SEQ ID NO: 683782 - DNA, 25 bp, Rattus norvegicus
ttgtacctaagtggatataaaagtt

SEQ ID NO: 683783 - DNA, 25 bp, Rattus norvegicus
ttgtacctaattccatgtgtccttg

SEQ ID NO: 683784 - DNA, 25 bp, Rattus norvegicus
ttgtacctaattgcatgtgtccttg

SEQ ID NO: 683785 - DNA, 25 bp, Rattus norvegicus
ttgtacctactgctaaacactctgc

SEQ ID NO: 683786 - DNA, 25 bp, Rattus norvegicus
ttgtacctactggtaaacactctgc

SEQ ID NO: 683787 - DNA, 25 bp, Rattus norvegicus
ttgtacctccaaagcttcctaggga

SEQ ID NO: 683788 - DNA, 25 bp, Rattus norvegicus
ttgtacctccaatgcttcctaggga

SEQ ID NO: 683789 - DNA, 25 bp, Rattus norvegicus
ttgtacctcctactttgcgagttct

SEQ ID NO: 683790 - DNA, 25 bp, Rattus norvegicus
ttgtacctcctagtttgcgagttct

SEQ ID NO: 683791 - DNA, 25 bp, Rattus norvegicus
ttgtacctcctcattgctctaagtc

SEQ ID NO: 683792 - DNA, 25 bp, Rattus norvegicus
ttgtacctcctctttgctctaagtc

SEQ ID NO: 683793 - DNA, 25 bp, Rattus norvegicus
ttgtacctctacattttctccctct

SEQ ID NO: 683794 - DNA, 25 bp, Rattus norvegicus
ttgtacctctactttttctccctct

SEQ ID NO: 683795 - DNA, 25 bp, Rattus norvegicus
ttgtacctgtttctggcttagcttt

SEQ ID NO: 683796 - DNA, 25 bp, Rattus norvegicus
ttgtacctgtttgtggcttagcttt

SEQ ID NO: 683797 - DNA, 25 bp, Rattus norvegicus
ttgtaccttcttatctaacgagcat

SEQ ID NO: 683798 - DNA, 25 bp, Rattus norvegicus
ttgtaccttcttttctaacgagcat

SEQ ID NO: 683799 - DNA, 25 bp, Rattus norvegicus
ttgtacgagctgacgtgtctacggc

SEQ ID NO: 683800 - DNA, 25 bp, Rattus norvegicus
ttgtacgagctgtcgtgtctacggc

SEQ ID NO: 683801 - DNA, 25 bp, Rattus norvegicus
ttgtacgctgtgaccgaacccggga

SEQ ID NO: 683802 - DNA, 25 bp, Rattus norvegicus
ttgtacgctgtgtccgaacccggga

SEQ ID NO: 683803 - DNA, 25 bp, Rattus norvegicus
ttgtacggcccactatgggtggtac

SEQ ID NO: 683804 - DNA, 25 bp, Rattus norvegicus
ttgtacggcccagtatgggtggtac

SEQ ID NO: 683805 - DNA, 25 bp, Rattus norvegicus
ttgtacgtggctaagttctggcaca

SEQ ID NO: 683806 - DNA, 25 bp, Rattus norvegicus
ttgtacgtggcttagttctggcaca

SEQ ID NO: 683807 - DNA, 25 bp, Rattus norvegicus
ttgtactacatgatcatctgcatgg

SEQ ID NO: 683808 - DNA, 25 bp, Rattus norvegicus
ttgtactacatgttcatctgcatgg

SEQ ID NO: 683809 - DNA, 25 bp, Rattus norvegicus
ttgtactaccaacagtatcccgggt

SEQ ID NO: 683810 - DNA, 25 bp, Rattus norvegicus
ttgtactaccaagagtatcccgggt

SEQ ID NO: 683811 - DNA, 25 bp, Rattus norvegicus
ttgtactaggtcattccatatgaaa

SEQ ID NO: 683812 - DNA, 25 bp, Rattus norvegicus
ttgtactaggtctttccatatgaaa

SEQ ID NO: 683813 - DNA, 25 bp, Rattus norvegicus
ttgtactattaaacccagtgcccca

SEQ ID NO: 683814 - DNA, 25 bp, Rattus norvegicus
ttgtactattaatcccagtgcccca

SEQ ID NO: 683815 - DNA, 25 bp, Rattus norvegicus
ttgtactattttatcccacttcgtg

SEQ ID NO: 683816 - DNA, 25 bp, Rattus norvegicus
ttgtactattttttcccacttcgtg

SEQ ID NO: 683817 - DNA, 25 bp, Rattus norvegicus
ttgtactcagaactcttactaataa

SEQ ID NO: 683818 - DNA, 25 bp, Rattus norvegicus
ttgtactcagaagtcttactaataa

SEQ ID NO: 683819 - DNA, 25 bp, Rattus norvegicus
ttgtactccggacccgccgtggtac

SEQ ID NO: 683820 - DNA, 25 bp, Rattus norvegicus
ttgtactccggagccgccgtggtac

SEQ ID NO: 683821 - DNA, 25 bp, Rattus norvegicus
ttgtactccttcctctgataattgt

SEQ ID NO: 683822 - DNA, 25 bp, Rattus norvegicus
ttgtactccttcgtctgataattgt

SEQ ID NO: 683823 - DNA, 25 bp, Rattus norvegicus
ttgtactctattatcctagccattg

SEQ ID NO: 683824 - DNA, 25 bp, Rattus norvegicus
ttgtactctattttcctagccattg

SEQ ID NO: 683825 - DNA, 25 bp, Rattus norvegicus
ttgtactgaacaaaatggcccgttt

SEQ ID NO: 683826 - DNA, 25 bp, Rattus norvegicus
ttgtactgaacataatggcccgttt

SEQ ID NO: 683827 - DNA, 25 bp, Rattus norvegicus
ttgtactgacttaccctgcttgtct

SEQ ID NO: 683828 - DNA, 25 bp, Rattus norvegicus
ttgtactgactttccctgcttgtct

SEQ ID NO: 683829 - DNA, 25 bp, Rattus norvegicus
ttgtactgggcacgcgtcagactac

SEQ ID NO: 683830 - DNA, 25 bp, Rattus norvegicus
ttgtactgggcaggcgtcagactac

SEQ ID NO: 683831 - DNA, 25 bp, Rattus norvegicus
ttgtactgtctccttactgatgtca

SEQ ID NO: 683832 - DNA, 25 bp, Rattus norvegicus
ttgtactgtctcgttactgatgtca

SEQ ID NO: 683833 - DNA, 25 bp, Rattus norvegicus
ttgtactgttcaaacagcgcccacg

SEQ ID NO: 683834 - DNA, 25 bp, Rattus norvegicus
ttgtactgttcatacagcgcccacg

SEQ ID NO: 683835 - DNA, 25 bp, Rattus norvegicus
ttgtacttaagtatgaccagctcac

SEQ ID NO: 683836 - DNA, 25 bp, Rattus norvegicus
ttgtacttaagtttgaccagctcac

SEQ ID NO: 683837 - DNA, 25 bp, Rattus norvegicus
ttgtacttaatcacatcggccgtag

SEQ ID NO: 683838 - DNA, 25 bp, Rattus norvegicus
ttgtacttaatctcatcggccgtag

SEQ ID NO: 683839 - DNA, 25 bp, Rattus norvegicus
ttgtacttcaaaaccccaggctgtc

SEQ ID NO: 683840 - DNA, 25 bp, Rattus norvegicus
ttgtacttcaaatccccaggctgtc

SEQ ID NO: 683841 - DNA, 25 bp, Rattus norvegicus
ttgtacttccaaatgtcacagtctg

SEQ ID NO: 683842 - DNA, 25 bp, Rattus norvegicus
ttgtacttccaattgtcacagtctg

SEQ ID NO: 683843 - DNA, 25 bp, Rattus norvegicus
ttgtacttccctccctcagaactaa

SEQ ID NO: 683844 - DNA, 25 bp, Rattus norvegicus
ttgtacttccctgcctcagaactaa

SEQ ID NO: 683845 - DNA, 25 bp, Rattus norvegicus
ttgtacttgataccttctccatgag

SEQ ID NO: 683846 - DNA, 25 bp, Rattus norvegicus
ttgtacttgatagcttctccatgag

SEQ ID NO: 683847 - DNA, 25 bp, Rattus norvegicus
ttgtacttgattccccagctgtctt

SEQ ID NO: 683848 - DNA, 25 bp, Rattus norvegicus
ttgtacttgattgcccagctgtctt

SEQ ID NO: 683849 - DNA, 25 bp, Rattus norvegicus
ttgtacttgccaacctttcattgtt

SEQ ID NO: 683850 - DNA, 25 bp, Rattus norvegicus
ttgtacttgccatcctttcattgtt

SEQ ID NO: 683851 - DNA, 25 bp, Rattus norvegicus
ttgtacttgctgattgcacccctga

SEQ ID NO: 683852 - DNA, 25 bp, Rattus norvegicus
ttgtacttgctgtttgcacccctga

SEQ ID NO: 683853 - DNA, 25 bp, Rattus norvegicus
ttgtacttggtaagcccctaggagc

SEQ ID NO: 683854 - DNA, 25 bp, Rattus norvegicus
ttgtacttggtacgccgggaacaca

SEQ ID NO: 683855 - DNA, 25 bp, Rattus norvegicus
ttgtacttggtaggccgggaacaca

SEQ ID NO: 683856 - DNA, 25 bp, Rattus norvegicus
ttgtacttggtatgcccctaggagc

SEQ ID NO: 683857 - DNA, 25 bp, Rattus norvegicus
ttgtactttacacacactgttccca

SEQ ID NO: 683858 - DNA, 25 bp, Rattus norvegicus
ttgtactttacagacactgttccca

SEQ ID NO: 683859 - DNA, 25 bp, Rattus norvegicus
ttgtactttagaagagtcccagaaa

SEQ ID NO: 683860 - DNA, 25 bp, Rattus norvegicus
ttgtactttagatgagtcccagaaa

SEQ ID NO: 683861 - DNA, 25 bp, Rattus norvegicus
ttgtagaactggatccacctggtgt

SEQ ID NO: 683862 - DNA, 25 bp, Rattus norvegicus
ttgtagaactggttccacctggtgt

SEQ ID NO: 683863 - DNA, 25 bp, Rattus norvegicus
ttgtagaacttcactgtctgccaaa

SEQ ID NO: 683864 - DNA, 25 bp, Rattus norvegicus
ttgtagaacttctctgtctgccaaa

SEQ ID NO: 683865 - DNA, 25 bp, Rattus norvegicus
ttgtagacacagctacctctctgct

SEQ ID NO: 683866 - DNA, 25 bp, Rattus norvegicus
ttgtagacacaggtacctctctgct

SEQ ID NO: 683867 - DNA, 25 bp, Rattus norvegicus
ttgtagacaggacctattgccccag

SEQ ID NO: 683868 - DNA, 25 bp, Rattus norvegicus
ttgtagacaggagctattgccccag

SEQ ID NO: 683869 - DNA, 25 bp, Rattus norvegicus
ttgtagacagtgaacttcccaccac

SEQ ID NO: 683870 - DNA, 25 bp, Rattus norvegicus
ttgtagacagtgtacttcccaccac

SEQ ID NO: 683871 - DNA, 25 bp, Rattus norvegicus
ttgtagaccaaactgcctgccttag

SEQ ID NO: 683872 - DNA, 25 bp, Rattus norvegicus
ttgtagaccaaagtgcctgccttag

SEQ ID NO: 683873 - DNA, 25 bp, Rattus norvegicus
ttgtagactctgcatctcatgactg

SEQ ID NO: 683874 - DNA, 25 bp, Rattus norvegicus
ttgtagactctggatctcatgactg

SEQ ID NO: 683875 - DNA, 25 bp, Rattus norvegicus
ttgtagagagaaacgtacactcaga

SEQ ID NO: 683876 - DNA, 25 bp, Rattus norvegicus
ttgtagagagaatcgtacactcaga

SEQ ID NO: 683877 - DNA, 25 bp, Rattus norvegicus
ttgtagatacggagactccagtctt

SEQ ID NO: 683878 - DNA, 25 bp, Rattus norvegicus
ttgtagatacggtgactccagtctt

SEQ ID NO: 683879 - DNA, 25 bp, Rattus norvegicus
ttgtagatcagcagacctcgtagtc

SEQ ID NO: 683880 - DNA, 25 bp, Rattus norvegicus
ttgtagatcagctgacctcgtagtc

SEQ ID NO: 683881 - DNA, 25 bp, Rattus norvegicus
ttgtagatgagtcctgcccttgagc

SEQ ID NO: 683882 - DNA, 25 bp, Rattus norvegicus
ttgtagatgagtgctgcccttgagc

SEQ ID NO: 683883 - DNA, 25 bp, Rattus norvegicus
ttgtagatgctcagctgggccagcg

SEQ ID NO: 683884 - DNA, 25 bp, Rattus norvegicus
ttgtagatgctctgctgggccagcg

SEQ ID NO: 683885 - DNA, 25 bp, Rattus norvegicus
ttgtagatttgtcctgtcattcccc

SEQ ID NO: 683886 - DNA, 25 bp, Rattus norvegicus
ttgtagatttgtgctgtcattcccc

SEQ ID NO: 683887 - DNA, 25 bp, Rattus norvegicus
ttgtagcagtagcttgctttggaat

SEQ ID NO: 683888 - DNA, 25 bp, Rattus norvegicus
ttgtagcagtaggttgctttggaat

SEQ ID NO: 683889 - DNA, 25 bp, Rattus norvegicus
ttgtagcagttgatcattgcccttt

SEQ ID NO: 683890 - DNA, 25 bp, Rattus norvegicus
ttgtagcagttgttcattgcccttt

SEQ ID NO: 683891 - DNA, 25 bp, Rattus norvegicus
ttgtagccagcaagggagtttattt

SEQ ID NO: 683892 - DNA, 25 bp, Rattus norvegicus
ttgtagccagcatgggagtttattt

SEQ ID NO: 683893 - DNA, 25 bp, Rattus norvegicus
ttgtagccccaaaatactgatgatg

SEQ ID NO: 683894 - DNA, 25 bp, Rattus norvegicus
ttgtagccccaatatactgatgatg

SEQ ID NO: 683895 - DNA, 25 bp, Rattus norvegicus
ttgtagccccatacctagtacagtg

SEQ ID NO: 683896 - DNA, 25 bp, Rattus norvegicus
ttgtagccccattcctagtacagtg

SEQ ID NO: 683897 - DNA, 25 bp, Rattus norvegicus
ttgtagccctgacccacgttggagc

SEQ ID NO: 683898 - DNA, 25 bp, Rattus norvegicus
ttgtagccctgagccacgttggagc

SEQ ID NO: 683899 - DNA, 25 bp, Rattus norvegicus
ttgtagcccttaattctatggtagg

SEQ ID NO: 683900 - DNA, 25 bp, Rattus norvegicus
ttgtagcccttatttctatggtagg

SEQ ID NO: 683901 - DNA, 25 bp, Rattus norvegicus
ttgtagcccttgcctggacttgaaa

SEQ ID NO: 683902 - DNA, 25 bp, Rattus norvegicus
ttgtagcccttggctggacttgaaa

SEQ ID NO: 683903 - DNA, 25 bp, Rattus norvegicus
ttgtagccgcaccactatttttagc

SEQ ID NO: 683904 - DNA, 25 bp, Rattus norvegicus
ttgtagccgcacgactatttttagc

SEQ ID NO: 683905 - DNA, 25 bp, Rattus norvegicus
ttgtagccttttcccttttagagaa

SEQ ID NO: 683906 - DNA, 25 bp, Rattus norvegicus
ttgtagccttttgccttttagagaa

SEQ ID NO: 683907 - DNA, 25 bp, Rattus norvegicus
ttgtagcgatgccagaaacttctca

SEQ ID NO: 683908 - DNA, 25 bp, Rattus norvegicus
ttgtagcgatgcgagaaacttctca

SEQ ID NO: 683909 - DNA, 25 bp, Rattus norvegicus
ttgtagcgctccatcgccggcgcgg

SEQ ID NO: 683910 - DNA, 25 bp, Rattus norvegicus
ttgtagcgctccttcgccggcgcgg

SEQ ID NO: 683911 - DNA, 25 bp, Rattus norvegicus
ttgtagcgctttattctttccatct

SEQ ID NO: 683912 - DNA, 25 bp, Rattus norvegicus
ttgtagcgcttttttctttccatct

SEQ ID NO: 683913 - DNA, 25 bp, Rattus norvegicus
ttgtagctattcagactatgtctct

SEQ ID NO: 683914 - DNA, 25 bp, Rattus norvegicus
ttgtagctattctgactatgtctct

SEQ ID NO: 683915 - DNA, 25 bp, Rattus norvegicus
ttgtagctcctgaagccaattccag

SEQ ID NO: 683916 - DNA, 25 bp, Rattus norvegicus
ttgtagctcctgacacattcagttc

SEQ ID NO: 683917 - DNA, 25 bp, Rattus norvegicus
ttgtagctcctgtagccaattccag

SEQ ID NO: 683918 - DNA, 25 bp, Rattus norvegicus
ttgtagctcctgtcacattcagttc

SEQ ID NO: 683919 - DNA, 25 bp, Rattus norvegicus
ttgtagctctctcctttttaactta

SEQ ID NO: 683920 - DNA, 25 bp, Rattus norvegicus
ttgtagctctctgctttttaactta

SEQ ID NO: 683921 - DNA, 25 bp, Rattus norvegicus
ttgtagctgtaaactccctcacaag

SEQ ID NO: 683922 - DNA, 25 bp, Rattus norvegicus
ttgtagctgtaatctccctcacaag

SEQ ID NO: 683923 - DNA, 25 bp, Rattus norvegicus
ttgtagctgttccagtttcacgtct

SEQ ID NO: 683924 - DNA, 25 bp, Rattus norvegicus
ttgtagctgttcgagtttcacgtct

SEQ ID NO: 683925 - DNA, 25 bp, Rattus norvegicus
ttgtagcttatgcttttcctccttt

SEQ ID NO: 683926 - DNA, 25 bp, Rattus norvegicus
ttgtagcttatggttttcctccttt

SEQ ID NO: 683927 - DNA, 25 bp, Rattus norvegicus
ttgtagcttgaaaccaatctgctgt

SEQ ID NO: 683928 - DNA, 25 bp, Rattus norvegicus
ttgtagcttgaatccaatctgctgt

SEQ ID NO: 683929 - DNA, 25 bp, Rattus norvegicus
ttgtagcttttcatttaattggcct

SEQ ID NO: 683930 - DNA, 25 bp, Rattus norvegicus
ttgtagcttttcttttaattggcct

SEQ ID NO: 683931 - DNA, 25 bp, Rattus norvegicus
ttgtaggactacctatccagcctat

SEQ ID NO: 683932 - DNA, 25 bp, Rattus norvegicus
ttgtaggactacgtatccagcctat

SEQ ID NO: 683933 - DNA, 25 bp, Rattus norvegicus
ttgtaggactggagtccccaaccct

SEQ ID NO: 683934 - DNA, 25 bp, Rattus norvegicus
ttgtaggactggtgtccccaaccct

SEQ ID NO: 683935 - DNA, 25 bp, Rattus norvegicus
ttgtaggcaaatctcctgtcttagt

SEQ ID NO: 683936 - DNA, 25 bp, Rattus norvegicus
ttgtaggcaaatgtcctgtcttagt

SEQ ID NO: 683937 - DNA, 25 bp, Rattus norvegicus
ttgtaggcaccaacatccgtatgag

SEQ ID NO: 683938 - DNA, 25 bp, Rattus norvegicus
ttgtaggcaccatcatccgtatgag

SEQ ID NO: 683939 - DNA, 25 bp, Rattus norvegicus
ttgtaggctgtccaaagcttgccag

SEQ ID NO: 683940 - DNA, 25 bp, Rattus norvegicus
ttgtaggctgtcgaaagcttgccag

SEQ ID NO: 683941 - DNA, 25 bp, Rattus norvegicus
ttgtagggcattaagccccagcttc

SEQ ID NO: 683942 - DNA, 25 bp, Rattus norvegicus
ttgtagggcatttagccccagcttc

SEQ ID NO: 683943 - DNA, 25 bp, Rattus norvegicus
ttgtagggcctcactcgggtgtgca

SEQ ID NO: 683944 - DNA, 25 bp, Rattus norvegicus
ttgtagggcctctctcgggtgtgca

SEQ ID NO: 683945 - DNA, 25 bp, Rattus norvegicus
ttgtagggtatcatcacagtagaaa

SEQ ID NO: 683946 - DNA, 25 bp, Rattus norvegicus
ttgtagggtatcttcacagtagaaa

SEQ ID NO: 683947 - DNA, 25 bp, Rattus norvegicus
ttgtaggtacgcatcatcgtgcctg

SEQ ID NO: 683948 - DNA, 25 bp, Rattus norvegicus
ttgtaggtacgcttcatcgtgcctg

SEQ ID NO: 683949 - DNA, 25 bp, Rattus norvegicus
ttgtaggtgcagcagtctctgtcat

SEQ ID NO: 683950 - DNA, 25 bp, Rattus norvegicus
ttgtaggtgcaggagtctctgtcat

SEQ ID NO: 683951 - DNA, 25 bp, Rattus norvegicus
ttgtaggttcccatgtcgtgacaaa

SEQ ID NO: 683952 - DNA, 25 bp, Rattus norvegicus
ttgtaggttcccttgtcgtgacaaa

SEQ ID NO: 683953 - DNA, 25 bp, Rattus norvegicus
ttgtagtactttcgtcttcccatca

SEQ ID NO: 683954 - DNA, 25 bp, Rattus norvegicus
ttgtagtactttggtcttcccatca

SEQ ID NO: 683955 - DNA, 25 bp, Rattus norvegicus
ttgtagtatctaactgccttgaaaa

SEQ ID NO: 683956 - DNA, 25 bp, Rattus norvegicus
ttgtagtatctatctgccttgaaaa

SEQ ID NO: 683957 - DNA, 25 bp, Rattus norvegicus
ttgtagtccggtatcctccataaca

SEQ ID NO: 683958 - DNA, 25 bp, Rattus norvegicus
ttgtagtccggtttcctccataaca

SEQ ID NO: 683959 - DNA, 25 bp, Rattus norvegicus
ttgtagtgtcagagtctgtggtcac

SEQ ID NO: 683960 - DNA, 25 bp, Rattus norvegicus
ttgtagtgtcagtgtctgtggtcac

SEQ ID NO: 683961 - DNA, 25 bp, Rattus norvegicus
ttgtagtgtgtcaacaccgttccca

SEQ ID NO: 683962 - DNA, 25 bp, Rattus norvegicus
ttgtagtgtgtctacaccgttccca

SEQ ID NO: 683963 - DNA, 25 bp, Rattus norvegicus
ttgtagttacttatgctttcttgag

SEQ ID NO: 683964 - DNA, 25 bp, Rattus norvegicus
ttgtagttacttttgctttcttgag

SEQ ID NO: 683965 - DNA, 25 bp, Rattus norvegicus
ttgtagttatcaaagctggctggca

SEQ ID NO: 683966 - DNA, 25 bp, Rattus norvegicus
ttgtagttatcatagctggctggca

SEQ ID NO: 683967 - DNA, 25 bp, Rattus norvegicus
ttgtagttcaagatacctgctgtta

SEQ ID NO: 683968 - DNA, 25 bp, Rattus norvegicus
ttgtagttcaagttacctgctgtta

SEQ ID NO: 683969 - DNA, 25 bp, Rattus norvegicus
ttgtagttggtcaaagcctccacgt

SEQ ID NO: 683970 - DNA, 25 bp, Rattus norvegicus
ttgtagttggtctaagcctccacgt

SEQ ID NO: 683971 - DNA, 25 bp, Rattus norvegicus
ttgtagttgtccctgcccataatac

SEQ ID NO: 683972 - DNA, 25 bp, Rattus norvegicus
ttgtagttgtccgtgcccataatac

SEQ ID NO: 683973 - DNA, 25 bp, Rattus norvegicus
ttgtagtttcttcgcctttcagcaa

SEQ ID NO: 683974 - DNA, 25 bp, Rattus norvegicus
ttgtagtttcttggcctttcagcaa

SEQ ID NO: 683975 - DNA, 25 bp, Rattus norvegicus
ttgtataactctaaacgcccatgat

SEQ ID NO: 683976 - DNA, 25 bp, Rattus norvegicus
ttgtataactcttaacgcccatgat

SEQ ID NO: 683977 - DNA, 25 bp, Rattus norvegicus
ttgtataatcgacagcccaggaggc

SEQ ID NO: 683978 - DNA, 25 bp, Rattus norvegicus
ttgtataatcgagagcccaggaggc

SEQ ID NO: 683979 - DNA, 25 bp, Rattus norvegicus
ttgtatacttttccactttcaaaag

SEQ ID NO: 683980 - DNA, 25 bp, Rattus norvegicus
ttgtatacttttgcactttcaaaag

SEQ ID NO: 683981 - DNA, 25 bp, Rattus norvegicus
ttgtatagctcacttgtatcctaag

SEQ ID NO: 683982 - DNA, 25 bp, Rattus norvegicus
ttgtatagctcagttgtatcctaag

SEQ ID NO: 683983 - DNA, 25 bp, Rattus norvegicus
ttgtatagctccactgcctgctgat

SEQ ID NO: 683984 - DNA, 25 bp, Rattus norvegicus
ttgtatagctcctctgcctgctgat

SEQ ID NO: 683985 - DNA, 25 bp, Rattus norvegicus
ttgtataggtttctatcctcttacg

SEQ ID NO: 683986 - DNA, 25 bp, Rattus norvegicus
ttgtataggtttgtatcctcttacg

SEQ ID NO: 683987 - DNA, 25 bp, Rattus norvegicus
ttgtatataaccactattcttttgc

SEQ ID NO: 683988 - DNA, 25 bp, Rattus norvegicus
ttgtatataacctctattcttttgc

SEQ ID NO: 683989 - DNA, 25 bp, Rattus norvegicus
ttgtatatgttcagttctcggtcgt

SEQ ID NO: 683990 - DNA, 25 bp, Rattus norvegicus
ttgtatatgttctgttctcggtcgt

SEQ ID NO: 683991 - DNA, 25 bp, Rattus norvegicus
ttgtatcaaagtagctgctccttcc

SEQ ID NO: 683992 - DNA, 25 bp, Rattus norvegicus
ttgtatcaaagttgctgctccttcc

SEQ ID NO: 683993 - DNA, 25 bp, Rattus norvegicus
ttgtatcacctaacccattaagctg

SEQ ID NO: 683994 - DNA, 25 bp, Rattus norvegicus
ttgtatcacctatcccattaagctg

SEQ ID NO: 683995 - DNA, 25 bp, Rattus norvegicus
ttgtatcagcgcactgctccgagtg

SEQ ID NO: 683996 - DNA, 25 bp, Rattus norvegicus
ttgtatcagcgctctgctccgagtg

SEQ ID NO: 683997 - DNA, 25 bp, Rattus norvegicus
ttgtatcattgtccctatagcctct

SEQ ID NO: 683998 - DNA, 25 bp, Rattus norvegicus
ttgtatcattgtgcctatagcctct

SEQ ID NO: 683999 - DNA, 25 bp, Rattus norvegicus
ttgtatccaaggagctgaatcttgg

SEQ ID NO: 684000 - DNA, 25 bp, Rattus norvegicus
ttgtatccaaggtgctgaatcttgg

SEQ ID NO: 684001 - DNA, 25 bp, Rattus norvegicus
ttgtatccaatcacctgtaggcagc

SEQ ID NO: 684002 - DNA, 25 bp, Rattus norvegicus
ttgtatccaatctcctgtaggcagc

SEQ ID NO: 684003 - DNA, 25 bp, Rattus norvegicus
ttgtatccactacacataccgctgt

SEQ ID NO: 684004 - DNA, 25 bp, Rattus norvegicus
ttgtatccactagacataccgctgt

SEQ ID NO: 684005 - DNA, 25 bp, Rattus norvegicus
ttgtatccatgacttctctgaatca

SEQ ID NO: 684006 - DNA, 25 bp, Rattus norvegicus
ttgtatccatgagttctctgaatca

SEQ ID NO: 684007 - DNA, 25 bp, Rattus norvegicus
ttgtatccccagaaagctctcaaaa

SEQ ID NO: 684008 - DNA, 25 bp, Rattus norvegicus
ttgtatccccagataactatccgtg

SEQ ID NO: 684009 - DNA, 25 bp, Rattus norvegicus
ttgtatccccagtaagctctcaaaa

SEQ ID NO: 684010 - DNA, 25 bp, Rattus norvegicus
ttgtatccccagttaactatccgtg

SEQ ID NO: 684011 - DNA, 25 bp, Rattus norvegicus
ttgtatccggtgacttaccagtctc

SEQ ID NO: 684012 - DNA, 25 bp, Rattus norvegicus
ttgtatccggtgtcttaccagtctc

SEQ ID NO: 684013 - DNA, 25 bp, Rattus norvegicus
ttgtatcctcaaagcccagcacata

SEQ ID NO: 684014 - DNA, 25 bp, Rattus norvegicus
ttgtatcctcaatgcccagcacata

SEQ ID NO: 684015 - DNA, 25 bp, Rattus norvegicus
ttgtatcgtcaaccccagtcagtaa

SEQ ID NO: 684016 - DNA, 25 bp, Rattus norvegicus
ttgtatcgtcaagcccagtcagtaa

SEQ ID NO: 684017 - DNA, 25 bp, Rattus norvegicus
ttgtatctaaaaccacctcgtctcc

SEQ ID NO: 684018 - DNA, 25 bp, Rattus norvegicus
ttgtatctaaaagcacctcgtctcc

SEQ ID NO: 684019 - DNA, 25 bp, Rattus norvegicus
ttgtatctaccaagcacccttgcga

SEQ ID NO: 684020 - DNA, 25 bp, Rattus norvegicus
ttgtatctaccatgcacccttgcga

SEQ ID NO: 684021 - DNA, 25 bp, Rattus norvegicus
ttgtatctagtgcaggaggtgtcca

SEQ ID NO: 684022 - DNA, 25 bp, Rattus norvegicus
ttgtatctagtggaggaggtgtcca

SEQ ID NO: 684023 - DNA, 25 bp, Rattus norvegicus
ttgtatctcctcacatttgtttcct

SEQ ID NO: 684024 - DNA, 25 bp, Rattus norvegicus
ttgtatctcctctcatttgtttcct

SEQ ID NO: 684025 - DNA, 25 bp, Rattus norvegicus
ttgtatctcctgctcacatgagctg

SEQ ID NO: 684026 - DNA, 25 bp, Rattus norvegicus
ttgtatctcctggtcacatgagctg

SEQ ID NO: 684027 - DNA, 25 bp, Rattus norvegicus
ttgtatctcgtcaagcatttgtctt

SEQ ID NO: 684028 - DNA, 25 bp, Rattus norvegicus
ttgtatctcgtctagcatttgtctt

SEQ ID NO: 684029 - DNA, 25 bp, Rattus norvegicus
ttgtatctggatacccatctgcaga

SEQ ID NO: 684030 - DNA, 25 bp, Rattus norvegicus
ttgtatctggattcccatctgcaga

SEQ ID NO: 684031 - DNA, 25 bp, Rattus norvegicus
ttgtatctgtcaactcgactttggg

SEQ ID NO: 684032 - DNA, 25 bp, Rattus norvegicus
ttgtatctgtcatctcgactttggg

SEQ ID NO: 684033 - DNA, 25 bp, Rattus norvegicus
ttgtatctgtctaccaataaagctg

SEQ ID NO: 684034 - DNA, 25 bp, Rattus norvegicus
ttgtatctgtcttccaataaagctg

SEQ ID NO: 684035 - DNA, 25 bp, Rattus norvegicus
ttgtatcttcttcagacctcaactt

SEQ ID NO: 684036 - DNA, 25 bp, Rattus norvegicus
ttgtatcttcttgagacctcaactt

SEQ ID NO: 684037 - DNA, 25 bp, Rattus norvegicus
ttgtatcttgagagcccaacaggca

SEQ ID NO: 684038 - DNA, 25 bp, Rattus norvegicus
ttgtatcttgagtgcccaacaggca

SEQ ID NO: 684039 - DNA, 25 bp, Rattus norvegicus
ttgtatcttgcacagcagccagcca

SEQ ID NO: 684040 - DNA, 25 bp, Rattus norvegicus
ttgtatcttgcagagcagccagcca

SEQ ID NO: 684041 - DNA, 25 bp, Rattus norvegicus
ttgtatgaacctcgacagacctctc

SEQ ID NO: 684042 - DNA, 25 bp, Rattus norvegicus
ttgtatgaacctggacagacctctc

SEQ ID NO: 684043 - DNA, 25 bp, Rattus norvegicus
ttgtatgaccttcgccatcctggag

SEQ ID NO: 684044 - DNA, 25 bp, Rattus norvegicus
ttgtatgaccttggccatcctggag

SEQ ID NO: 684045 - DNA, 25 bp, Rattus norvegicus
ttgtatgagtgcatcctgtgtgcct

SEQ ID NO: 684046 - DNA, 25 bp, Rattus norvegicus
ttgtatgagtgcttcctgtgtgcct

SEQ ID NO: 684047 - DNA, 25 bp, Rattus norvegicus
ttgtatgcagatcaagggccccttt

SEQ ID NO: 684048 - DNA, 25 bp, Rattus norvegicus
ttgtatgcagatgaagggccccttt

SEQ ID NO: 684049 - DNA, 25 bp, Rattus norvegicus
ttgtatgccactctgccctgtgtag

SEQ ID NO: 684050 - DNA, 25 bp, Rattus norvegicus
ttgtatgccactgtgccctgtgtag

SEQ ID NO: 684051 - DNA, 25 bp, Rattus norvegicus
ttgtatgcctggctctgctaggcgc

SEQ ID NO: 684052 - DNA, 25 bp, Rattus norvegicus
ttgtatgcctgggtctgctaggcgc

SEQ ID NO: 684053 - DNA, 25 bp, Rattus norvegicus
ttgtatgctgtgagaccactggcac

SEQ ID NO: 684054 - DNA, 25 bp, Rattus norvegicus
ttgtatgctgtgtgaccactggcac

SEQ ID NO: 684055 - DNA, 25 bp, Rattus norvegicus
ttgtatgcttgtctctggccattaa

SEQ ID NO: 684056 - DNA, 25 bp, Rattus norvegicus
ttgtatgcttgtgtctggccattaa

SEQ ID NO: 684057 - DNA, 25 bp, Rattus norvegicus
ttgtatgcttttccgtaacagtgag

SEQ ID NO: 684058 - DNA, 25 bp, Rattus norvegicus
ttgtatgcttttgcgtaacagtgag

SEQ ID NO: 684059 - DNA, 25 bp, Rattus norvegicus
ttgtatggacctcgagtatctgttg

SEQ ID NO: 684060 - DNA, 25 bp, Rattus norvegicus
ttgtatggacctggagtatctgttg

SEQ ID NO: 684061 - DNA, 25 bp, Rattus norvegicus
ttgtatgtaatgctagtctccgaaa

SEQ ID NO: 684062 - DNA, 25 bp, Rattus norvegicus
ttgtatgtaatggtagtctccgaaa

SEQ ID NO: 684063 - DNA, 25 bp, Rattus norvegicus
ttgtatgtccatcctgtgactttct

SEQ ID NO: 684064 - DNA, 25 bp, Rattus norvegicus
ttgtatgtccatgctgtgactttct

SEQ ID NO: 684065 - DNA, 25 bp, Rattus norvegicus
ttgtatgtcccaattttggaggctg

SEQ ID NO: 684066 - DNA, 25 bp, Rattus norvegicus
ttgtatgtcccatttttggaggctg

SEQ ID NO: 684067 - DNA, 25 bp, Rattus norvegicus
ttgtatgtgagacctcgcttttctc

SEQ ID NO: 684068 - DNA, 25 bp, Rattus norvegicus
ttgtatgtgagagctcgcttttctc

SEQ ID NO: 684069 - DNA, 25 bp, Rattus norvegicus
ttgtatgtgtgtccgggcgtccctt

SEQ ID NO: 684070 - DNA, 25 bp, Rattus norvegicus
ttgtatgtgtgtgcgggcgtccctt

SEQ ID NO: 684071 - DNA, 25 bp, Rattus norvegicus
ttgtattatgtgctctgtagcctac

SEQ ID NO: 684072 - DNA, 25 bp, Rattus norvegicus
ttgtattatgtggtctgtagcctac

SEQ ID NO: 684073 - DNA, 25 bp, Rattus norvegicus
ttgtattcaatactgtatctcatag

SEQ ID NO: 684074 - DNA, 25 bp, Rattus norvegicus
ttgtattcaatagtgtatctcatag

SEQ ID NO: 684075 - DNA, 25 bp, Rattus norvegicus
ttgtattcagccattgctcgtttgc

SEQ ID NO: 684076 - DNA, 25 bp, Rattus norvegicus
ttgtattcagcctttgctcgtttgc

SEQ ID NO: 684077 - DNA, 25 bp, Rattus norvegicus
ttgtattcccatattctcaggctcc

SEQ ID NO: 684078 - DNA, 25 bp, Rattus norvegicus
ttgtattcccattttctcaggctcc

SEQ ID NO: 684079 - DNA, 25 bp, Rattus norvegicus
ttgtattcccgcattttcctttgct

SEQ ID NO: 684080 - DNA, 25 bp, Rattus norvegicus
ttgtattcccgctttttcctttgct

SEQ ID NO: 684081 - DNA, 25 bp, Rattus norvegicus
ttgtattccctcagtcgattcaata

SEQ ID NO: 684082 - DNA, 25 bp, Rattus norvegicus
ttgtattccctctgtcgattcaata

SEQ ID NO: 684083 - DNA, 25 bp, Rattus norvegicus
ttgtattcccttctagggtcacact

SEQ ID NO: 684084 - DNA, 25 bp, Rattus norvegicus
ttgtattcccttgtagggtcacact

SEQ ID NO: 684085 - DNA, 25 bp, Rattus norvegicus
ttgtattcctttccccggatggaat

SEQ ID NO: 684086 - DNA, 25 bp, Rattus norvegicus
ttgtattcctttgcccggatggaat

SEQ ID NO: 684087 - DNA, 25 bp, Rattus norvegicus
ttgtattctggccagaggctcatgt

SEQ ID NO: 684088 - DNA, 25 bp, Rattus norvegicus
ttgtattctggcgagaggctcatgt

SEQ ID NO: 684089 - DNA, 25 bp, Rattus norvegicus
ttgtattcttatcccttttcaatat

SEQ ID NO: 684090 - DNA, 25 bp, Rattus norvegicus
ttgtattcttatgccttttcaatat

SEQ ID NO: 684091 - DNA, 25 bp, Rattus norvegicus
ttgtattcttctccagtctgcttgc

SEQ ID NO: 684092 - DNA, 25 bp, Rattus norvegicus
ttgtattcttctgcagtctgcttgc

SEQ ID NO: 684093 - DNA, 25 bp, Rattus norvegicus
ttgtattgaatgagtctgtcccctc

SEQ ID NO: 684094 - DNA, 25 bp, Rattus norvegicus
ttgtattgaatgtgtctgtcccctc

SEQ ID NO: 684095 - DNA, 25 bp, Rattus norvegicus
ttgtattgtgggatcttagcctata

SEQ ID NO: 684096 - DNA, 25 bp, Rattus norvegicus
ttgtattgtgggttcttagcctata

SEQ ID NO: 684097 - DNA, 25 bp, Rattus norvegicus
ttgtattgtggtaatttcctatgca

SEQ ID NO: 684098 - DNA, 25 bp, Rattus norvegicus
ttgtattgtggttatttcctatgca

SEQ ID NO: 684099 - DNA, 25 bp, Rattus norvegicus
ttgtattgtgtcctgtagctgtcaa

SEQ ID NO: 684100 - DNA, 25 bp, Rattus norvegicus
ttgtattgtgtcgtgtagctgtcaa

SEQ ID NO: 684101 - DNA, 25 bp, Rattus norvegicus
ttgtattgttgacagattccccacc

SEQ ID NO: 684102 - DNA, 25 bp, Rattus norvegicus
ttgtattgttgagagattccccacc

SEQ ID NO: 684103 - DNA, 25 bp, Rattus norvegicus
ttgtatttaattccttttcttgctt

SEQ ID NO: 684104 - DNA, 25 bp, Rattus norvegicus
ttgtatttaattgcttttcttgctt

SEQ ID NO: 684105 - DNA, 25 bp, Rattus norvegicus
ttgtatttcagtcagcatggtgagc

SEQ ID NO: 684106 - DNA, 25 bp, Rattus norvegicus
ttgtatttcagtgagcatggtgagc

SEQ ID NO: 684107 - DNA, 25 bp, Rattus norvegicus
ttgtatttccctcttgtcttctcaa

SEQ ID NO: 684108 - DNA, 25 bp, Rattus norvegicus
ttgtatttccctgttgtcttctcaa

SEQ ID NO: 684109 - DNA, 25 bp, Rattus norvegicus
ttgtatttcgctagcagctgtggcc

SEQ ID NO: 684110 - DNA, 25 bp, Rattus norvegicus
ttgtatttcgcttgcagctgtggcc

SEQ ID NO: 684111 - DNA, 25 bp, Rattus norvegicus
ttgtatttcgttcccgtacctatga

SEQ ID NO: 684112 - DNA, 25 bp, Rattus norvegicus
ttgtatttcgttgccgtacctatga

SEQ ID NO: 684113 - DNA, 25 bp, Rattus norvegicus
ttgtatttgaggatacttccccata

SEQ ID NO: 684114 - DNA, 25 bp, Rattus norvegicus
ttgtatttgaggttacttccccata

SEQ ID NO: 684115 - DNA, 25 bp, Rattus norvegicus
ttgtattttacaaatctccctcccg

SEQ ID NO: 684116 - DNA, 25 bp, Rattus norvegicus
ttgtattttacatatctccctcccg

SEQ ID NO: 684117 - DNA, 25 bp, Rattus norvegicus
ttgtattttcctcccttgggagttt

SEQ ID NO: 684118 - DNA, 25 bp, Rattus norvegicus
ttgtattttcctgccttgggagttt

SEQ ID NO: 684119 - DNA, 25 bp, Rattus norvegicus
ttgtattttctaactacccacaggg

SEQ ID NO: 684120 - DNA, 25 bp, Rattus norvegicus
ttgtattttctatctacccacaggg

SEQ ID NO: 684121 - DNA, 25 bp, Rattus norvegicus
ttgtattttgtgcatgcccttgaaa

SEQ ID NO: 684122 - DNA, 25 bp, Rattus norvegicus
ttgtattttgtggatgcccttgaaa

SEQ ID NO: 684123 - DNA, 25 bp, Rattus norvegicus
ttgtattttgttctgggcccaggga

SEQ ID NO: 684124 - DNA, 25 bp, Rattus norvegicus
ttgtattttgttgtgggcccaggga

SEQ ID NO: 684125 - DNA, 25 bp, Rattus norvegicus
ttgtatttttcaacctgcaggcgtt

SEQ ID NO: 684126 - DNA, 25 bp, Rattus norvegicus
ttgtatttttcatcctgcaggcgtt

SEQ ID NO: 684127 - DNA, 25 bp, Rattus norvegicus
ttgtatttttctctgatttccctcc

SEQ ID NO: 684128 - DNA, 25 bp, Rattus norvegicus
ttgtatttttctgtgatttccctcc

SEQ ID NO: 684129 - DNA, 25 bp, Rattus norvegicus
ttgtcaaacacacctccttggaggg

SEQ ID NO: 684130 - DNA, 25 bp, Rattus norvegicus
ttgtcaaacacagctccttggaggg

SEQ ID NO: 684131 - DNA, 25 bp, Rattus norvegicus
ttgtcaaactgcaccacacacgttg

SEQ ID NO: 684132 - DNA, 25 bp, Rattus norvegicus
ttgtcaaactgctccacacacgttg

SEQ ID NO: 684133 - DNA, 25 bp, Rattus norvegicus
ttgtcaaaggttccatcttcccatc

SEQ ID NO: 684134 - DNA, 25 bp, Rattus norvegicus
ttgtcaaaggttgcatcttcccatc

SEQ ID NO: 684135 - DNA, 25 bp, Rattus norvegicus
ttgtcaaatcccaggaagaccccta

SEQ ID NO: 684136 - DNA, 25 bp, Rattus norvegicus
ttgtcaaatccctggaagaccccta

SEQ ID NO: 684137 - DNA, 25 bp, Rattus norvegicus
ttgtcaacaacgactgtgcagggct

SEQ ID NO: 684138 - DNA, 25 bp, Rattus norvegicus
ttgtcaacaacgtctgtgcagggct

SEQ ID NO: 684139 - DNA, 25 bp, Rattus norvegicus
ttgtcaacagataggctccgcccag

SEQ ID NO: 684140 - DNA, 25 bp, Rattus norvegicus
ttgtcaacagattggctccgcccag

SEQ ID NO: 684141 - DNA, 25 bp, Rattus norvegicus
ttgtcaaccctgctttcactaatgt

SEQ ID NO: 684142 - DNA, 25 bp, Rattus norvegicus
ttgtcaaccctggtttcactaatgt

SEQ ID NO: 684143 - DNA, 25 bp, Rattus norvegicus
ttgtcaactcagaacacacctctag

SEQ ID NO: 684144 - DNA, 25 bp, Rattus norvegicus
ttgtcaactcagtacacacctctag

SEQ ID NO: 684145 - DNA, 25 bp, Rattus norvegicus
ttgtcaactgagctagggaccgcct

SEQ ID NO: 684146 - DNA, 25 bp, Rattus norvegicus
ttgtcaactgaggtagggaccgcct

SEQ ID NO: 684147 - DNA, 25 bp, Rattus norvegicus
ttgtcaagagaacctcatgcctcac

SEQ ID NO: 684148 - DNA, 25 bp, Rattus norvegicus
ttgtcaagagaagctcatgcctcac

SEQ ID NO: 684149 - DNA, 25 bp, Rattus norvegicus
ttgtcaagttgacctcagggaccaa

SEQ ID NO: 684150 - DNA, 25 bp, Rattus norvegicus
ttgtcaagttgagctcagggaccaa

SEQ ID NO: 684151 - DNA, 25 bp, Rattus norvegicus
ttgtcaatacctaccaattcgtctg

SEQ ID NO: 684152 - DNA, 25 bp, Rattus norvegicus
ttgtcaataccttccaattcgtctg

SEQ ID NO: 684153 - DNA, 25 bp, Rattus norvegicus
ttgtcaatggcaaggttttgatccc

SEQ ID NO: 684154 - DNA, 25 bp, Rattus norvegicus
ttgtcaatggcatggttttgatccc

SEQ ID NO: 684155 - DNA, 25 bp, Rattus norvegicus
ttgtcaatggtaaccgtcgtgtcat

SEQ ID NO: 684156 - DNA, 25 bp, Rattus norvegicus
ttgtcaatggtatccgtcgtgtcat

SEQ ID NO: 684157 - DNA, 25 bp, Rattus norvegicus
ttgtcacaacccatgaagctggcct

SEQ ID NO: 684158 - DNA, 25 bp, Rattus norvegicus
ttgtcacaacccttgaagctggcct

SEQ ID NO: 684159 - DNA, 25 bp, Rattus norvegicus
ttgtcacaagctcacactggcccag

SEQ ID NO: 684160 - DNA, 25 bp, Rattus norvegicus
ttgtcacaagctgacactggcccag

SEQ ID NO: 684161 - DNA, 25 bp, Rattus norvegicus
ttgtcacaatttactcggttttcag

SEQ ID NO: 684162 - DNA, 25 bp, Rattus norvegicus
ttgtcacaattttctcggttttcag

SEQ ID NO: 684163 - DNA, 25 bp, Rattus norvegicus
ttgtcacagcacattgaggtagcat

SEQ ID NO: 684164 - DNA, 25 bp, Rattus norvegicus
ttgtcacagcactttgaggtagcat

SEQ ID NO: 684165 - DNA, 25 bp, Rattus norvegicus
ttgtcacagctcaaacctcacatat

SEQ ID NO: 684166 - DNA, 25 bp, Rattus norvegicus
ttgtcacagctctaacctcacatat

SEQ ID NO: 684167 - DNA, 25 bp, Rattus norvegicus
ttgtcacagctgcaggctcacaata

SEQ ID NO: 684168 - DNA, 25 bp, Rattus norvegicus
ttgtcacagctggaggctcacaata

SEQ ID NO: 684169 - DNA, 25 bp, Rattus norvegicus
ttgtcacaggttcaggctctcacag

SEQ ID NO: 684170 - DNA, 25 bp, Rattus norvegicus
ttgtcacaggttgaggctctcacag

SEQ ID NO: 684171 - DNA, 25 bp, Rattus norvegicus
ttgtcacagtgcaggaccgcagata

SEQ ID NO: 684172 - DNA, 25 bp, Rattus norvegicus
ttgtcacagtgctggaccgcagata

SEQ ID NO: 684173 - DNA, 25 bp, Rattus norvegicus
ttgtcacagtgtagccagagctgta

SEQ ID NO: 684174 - DNA, 25 bp, Rattus norvegicus
ttgtcacagtgttgccagagctgta

SEQ ID NO: 684175 - DNA, 25 bp, Rattus norvegicus
ttgtcaccaccaactggactggact

SEQ ID NO: 684176 - DNA, 25 bp, Rattus norvegicus
ttgtcaccaccatctggactggact

SEQ ID NO: 684177 - DNA, 25 bp, Rattus norvegicus
ttgtcaccagtccttcctagatgga

SEQ ID NO: 684178 - DNA, 25 bp, Rattus norvegicus
ttgtcaccagtcgttcctagatgga

SEQ ID NO: 684179 - DNA, 25 bp, Rattus norvegicus
ttgtcaccatacctgatatcctgta

SEQ ID NO: 684180 - DNA, 25 bp, Rattus norvegicus
ttgtcaccatacgtgatatcctgta

SEQ ID NO: 684181 - DNA, 25 bp, Rattus norvegicus
ttgtcaccatgaagttcctggcact

SEQ ID NO: 684182 - DNA, 25 bp, Rattus norvegicus
ttgtcaccatgatgttcctggcact

SEQ ID NO: 684183 - DNA, 25 bp, Rattus norvegicus
ttgtcacccaaacgactgagcacag

SEQ ID NO: 684184 - DNA, 25 bp, Rattus norvegicus
ttgtcacccaaaggactgagcacag

SEQ ID NO: 684185 - DNA, 25 bp, Rattus norvegicus
ttgtcacccacccagataggtacgg

SEQ ID NO: 684186 - DNA, 25 bp, Rattus norvegicus
ttgtcacccaccgagataggtacgg

SEQ ID NO: 684187 - DNA, 25 bp, Rattus norvegicus
ttgtcacccagcaattaagacgttt

SEQ ID NO: 684188 - DNA, 25 bp, Rattus norvegicus
ttgtcacccagctattaagacgttt

SEQ ID NO: 684189 - DNA, 25 bp, Rattus norvegicus
ttgtcacccatcaagtcacagattc

SEQ ID NO: 684190 - DNA, 25 bp, Rattus norvegicus
ttgtcacccatctagtcacagattc

SEQ ID NO: 684191 - DNA, 25 bp, Rattus norvegicus
ttgtcacccgcaccagtcaggcagt

SEQ ID NO: 684192 - DNA, 25 bp, Rattus norvegicus
ttgtcacccgcagcagtcaggcagt

SEQ ID NO: 684193 - DNA, 25 bp, Rattus norvegicus
ttgtcaccctgcaaagaatgtcttt

SEQ ID NO: 684194 - DNA, 25 bp, Rattus norvegicus
ttgtcaccctgcagctgatgttctt

SEQ ID NO: 684195 - DNA, 25 bp, Rattus norvegicus
ttgtcaccctgctaagaatgtcttt

SEQ ID NO: 684196 - DNA, 25 bp, Rattus norvegicus
ttgtcaccctgctgctgatgttctt

SEQ ID NO: 684197 - DNA, 25 bp, Rattus norvegicus
ttgtcacccttaccagttgctgtta

SEQ ID NO: 684198 - DNA, 25 bp, Rattus norvegicus
ttgtcacccttagcagttgctgtta

SEQ ID NO: 684199 - DNA, 25 bp, Rattus norvegicus
ttgtcacccttcaggaacctgaaag

SEQ ID NO: 684200 - DNA, 25 bp, Rattus norvegicus
ttgtcacccttctggaacctgaaag

SEQ ID NO: 684201 - DNA, 25 bp, Rattus norvegicus
ttgtcaccctttagagtgccctgta

SEQ ID NO: 684202 - DNA, 25 bp, Rattus norvegicus
ttgtcacccttttgagtgccctgta

SEQ ID NO: 684203 - DNA, 25 bp, Rattus norvegicus
ttgtcaccgccacctgtggaggaca

SEQ ID NO: 684204 - DNA, 25 bp, Rattus norvegicus
ttgtcaccgccagctgtggaggaca

SEQ ID NO: 684205 - DNA, 25 bp, Rattus norvegicus
ttgtcaccgcgaaccggacgcgaag

SEQ ID NO: 684206 - DNA, 25 bp, Rattus norvegicus
ttgtcaccgcgatccggacgcgaag

SEQ ID NO: 684207 - DNA, 25 bp, Rattus norvegicus
ttgtcaccgtgccagtctcagggaa

SEQ ID NO: 684208 - DNA, 25 bp, Rattus norvegicus
ttgtcaccgtgcgagtctcagggaa

SEQ ID NO: 684209 - DNA, 25 bp, Rattus norvegicus
ttgtcacctctgctaaccttcagag

SEQ ID NO: 684210 - DNA, 25 bp, Rattus norvegicus
ttgtcacctctggtaaccttcagag

SEQ ID NO: 684211 - DNA, 25 bp, Rattus norvegicus
ttgtcacctcttatcattgtctagt

SEQ ID NO: 684212 - DNA, 25 bp, Rattus norvegicus
ttgtcacctcttttcattgtctagt

SEQ ID NO: 684213 - DNA, 25 bp, Rattus norvegicus
ttgtcacctgctctaggcaagcgat

SEQ ID NO: 684214 - DNA, 25 bp, Rattus norvegicus
ttgtcacctgctgtaggcaagcgat

SEQ ID NO: 684215 - DNA, 25 bp, Rattus norvegicus
ttgtcacctggactccacataggat

SEQ ID NO: 684216 - DNA, 25 bp, Rattus norvegicus
ttgtcacctggagtccacataggat

SEQ ID NO: 684217 - DNA, 25 bp, Rattus norvegicus
ttgtcacgcagcaaggtctcagtga

SEQ ID NO: 684218 - DNA, 25 bp, Rattus norvegicus
ttgtcacgcagctaggtctcagtga

SEQ ID NO: 684219 - DNA, 25 bp, Rattus norvegicus
ttgtcacggcagctcccatttgaag

SEQ ID NO: 684220 - DNA, 25 bp, Rattus norvegicus
ttgtcacggcaggtcccatttgaag

SEQ ID NO: 684221 - DNA, 25 bp, Rattus norvegicus
ttgtcacgtgacagctctctaaagg

SEQ ID NO: 684222 - DNA, 25 bp, Rattus norvegicus
ttgtcacgtgactgctctctaaagg

SEQ ID NO: 684223 - DNA, 25 bp, Rattus norvegicus
ttgtcactacttctatctcagggtt

SEQ ID NO: 684224 - DNA, 25 bp, Rattus norvegicus
ttgtcactacttgtatctcagggtt

SEQ ID NO: 684225 - DNA, 25 bp, Rattus norvegicus
ttgtcactagctcggcatgtgccaa

SEQ ID NO: 684226 - DNA, 25 bp, Rattus norvegicus
ttgtcactagctgggcatgtgccaa

SEQ ID NO: 684227 - DNA, 25 bp, Rattus norvegicus
ttgtcactcctcatacaaaggccta

SEQ ID NO: 684228 - DNA, 25 bp, Rattus norvegicus
ttgtcactcctcttacaaaggccta

SEQ ID NO: 684229 - DNA, 25 bp, Rattus norvegicus
ttgtcactcgacctatagagtctgt

SEQ ID NO: 684230 - DNA, 25 bp, Rattus norvegicus
ttgtcactcgacgtatagagtctgt

SEQ ID NO: 684231 - DNA, 25 bp, Rattus norvegicus
ttgtcactgcctccgaaactaacag

SEQ ID NO: 684232 - DNA, 25 bp, Rattus norvegicus
ttgtcactgcctgcgaaactaacag

SEQ ID NO: 684233 - DNA, 25 bp, Rattus norvegicus
ttgtcactggaactcactcttcaag

SEQ ID NO: 684234 - DNA, 25 bp, Rattus norvegicus
ttgtcactggaagtcactcttcaag

SEQ ID NO: 684235 - DNA, 25 bp, Rattus norvegicus
ttgtcactggctcgaaaatgtcatc

SEQ ID NO: 684236 - DNA, 25 bp, Rattus norvegicus
ttgtcactggctggaaaatgtcatc

SEQ ID NO: 684237 - DNA, 25 bp, Rattus norvegicus
ttgtcactgtgtcgcacaagaagtt

SEQ ID NO: 684238 - DNA, 25 bp, Rattus norvegicus
ttgtcactgtgtggcacaagaagtt

SEQ ID NO: 684239 - DNA, 25 bp, Rattus norvegicus
ttgtcacttattcagagccaggctc

SEQ ID NO: 684240 - DNA, 25 bp, Rattus norvegicus
ttgtcacttattgagagccaggctc

SEQ ID NO: 684241 - DNA, 25 bp, Rattus norvegicus
ttgtcacttccaccaaaccagatct

SEQ ID NO: 684242 - DNA, 25 bp, Rattus norvegicus
ttgtcacttccagcaaaccagatct

SEQ ID NO: 684243 - DNA, 25 bp, Rattus norvegicus
ttgtcacttcctacttaatgcggtg

SEQ ID NO: 684244 - DNA, 25 bp, Rattus norvegicus
ttgtcacttccttcttaatgcggtg

SEQ ID NO: 684245 - DNA, 25 bp, Rattus norvegicus
ttgtcacttgaaacctgtagctgtc

SEQ ID NO: 684246 - DNA, 25 bp, Rattus norvegicus
ttgtcacttgaatcctgtagctgtc

SEQ ID NO: 684247 - DNA, 25 bp, Rattus norvegicus
ttgtcactttatacccaaagagggt

SEQ ID NO: 684248 - DNA, 25 bp, Rattus norvegicus
ttgtcactttattcccaaagagggt

SEQ ID NO: 684249 - DNA, 25 bp, Rattus norvegicus
ttgtcagaaacaccttcccgtctat

SEQ ID NO: 684250 - DNA, 25 bp, Rattus norvegicus
ttgtcagaaacagcttcccgtctat

SEQ ID NO: 684251 - DNA, 25 bp, Rattus norvegicus
ttgtcagaacaaacttaccaccacc

SEQ ID NO: 684252 - DNA, 25 bp, Rattus norvegicus
ttgtcagaacaatcttaccaccacc

SEQ ID NO: 684253 - DNA, 25 bp, Rattus norvegicus
ttgtcagaactactgtgtcctccag

SEQ ID NO: 684254 - DNA, 25 bp, Rattus norvegicus
ttgtcagaactagtgtgtcctccag

SEQ ID NO: 684255 - DNA, 25 bp, Rattus norvegicus
ttgtcagaagaaatcaccacctggt

SEQ ID NO: 684256 - DNA, 25 bp, Rattus norvegicus
ttgtcagaagaattcaccacctggt

SEQ ID NO: 684257 - DNA, 25 bp, Rattus norvegicus
ttgtcagaagacacttttgagggtt

SEQ ID NO: 684258 - DNA, 25 bp, Rattus norvegicus
ttgtcagaagactcttttgagggtt

SEQ ID NO: 684259 - DNA, 25 bp, Rattus norvegicus
ttgtcagagtctcctgggtcccctg

SEQ ID NO: 684260 - DNA, 25 bp, Rattus norvegicus
ttgtcagagtctgctgggtcccctg

SEQ ID NO: 684261 - DNA, 25 bp, Rattus norvegicus
ttgtcagcaagaacagccggcagtc

SEQ ID NO: 684262 - DNA, 25 bp, Rattus norvegicus
ttgtcagcaagaagtccccgctaga

SEQ ID NO: 684263 - DNA, 25 bp, Rattus norvegicus
ttgtcagcaagatcagccggcagtc

SEQ ID NO: 684264 - DNA, 25 bp, Rattus norvegicus
ttgtcagcaagatgtccccgctaga

SEQ ID NO: 684265 - DNA, 25 bp, Rattus norvegicus
ttgtcagcaagcctgatcacctgag

SEQ ID NO: 684266 - DNA, 25 bp, Rattus norvegicus
ttgtcagcaagcgtgatcacctgag

SEQ ID NO: 684267 - DNA, 25 bp, Rattus norvegicus
ttgtcagcacttaccagtttaccat

SEQ ID NO: 684268 - DNA, 25 bp, Rattus norvegicus
ttgtcagcactttccagtttaccat

SEQ ID NO: 684269 - DNA, 25 bp, Rattus norvegicus
ttgtcagcagcgcagcagccgagcc

SEQ ID NO: 684270 - DNA, 25 bp, Rattus norvegicus
ttgtcagcagcggagcagccgagcc

SEQ ID NO: 684271 - DNA, 25 bp, Rattus norvegicus
ttgtcagcatgtcgatggcacgcac

SEQ ID NO: 684272 - DNA, 25 bp, Rattus norvegicus
ttgtcagcatgtggatggcacgcac

SEQ ID NO: 684273 - DNA, 25 bp, Rattus norvegicus
ttgtcagccagtcggttatgcacct

SEQ ID NO: 684274 - DNA, 25 bp, Rattus norvegicus
ttgtcagccagtgggttatgcacct

SEQ ID NO: 684275 - DNA, 25 bp, Rattus norvegicus
ttgtcagccatcaacagtgacccag

SEQ ID NO: 684276 - DNA, 25 bp, Rattus norvegicus
ttgtcagccatctacagtgacccag

SEQ ID NO: 684277 - DNA, 25 bp, Rattus norvegicus
ttgtcagctcagacccataaatgtt

SEQ ID NO: 684278 - DNA, 25 bp, Rattus norvegicus
ttgtcagctcagtcccataaatgtt

SEQ ID NO: 684279 - DNA, 25 bp, Rattus norvegicus
ttgtcagctctgattaaagttcccc

SEQ ID NO: 684280 - DNA, 25 bp, Rattus norvegicus
ttgtcagctctgtttaaagttcccc

SEQ ID NO: 684281 - DNA, 25 bp, Rattus norvegicus
ttgtcagctgtgctctgttgataca

SEQ ID NO: 684282 - DNA, 25 bp, Rattus norvegicus
ttgtcagctgtgcttgtctctgctc

SEQ ID NO: 684283 - DNA, 25 bp, Rattus norvegicus
ttgtcagctgtggtctgttgataca

SEQ ID NO: 684284 - DNA, 25 bp, Rattus norvegicus
ttgtcagctgtggttgtctctgctc

SEQ ID NO: 684285 - DNA, 25 bp, Rattus norvegicus
ttgtcaggaagtcaggagcacgcac

SEQ ID NO: 684286 - DNA, 25 bp, Rattus norvegicus
ttgtcaggaagtgaggagcacgcac

SEQ ID NO: 684287 - DNA, 25 bp, Rattus norvegicus
ttgtcaggacagacggcgctccggt

SEQ ID NO: 684288 - DNA, 25 bp, Rattus norvegicus
ttgtcaggacagtcggcgctccggt

SEQ ID NO: 684289 - DNA, 25 bp, Rattus norvegicus
ttgtcaggagacacccctgcagggt

SEQ ID NO: 684290 - DNA, 25 bp, Rattus norvegicus
ttgtcaggagactcccctgcagggt

SEQ ID NO: 684291 - DNA, 25 bp, Rattus norvegicus
ttgtcaggaggcacagcctggagaa

SEQ ID NO: 684292 - DNA, 25 bp, Rattus norvegicus
ttgtcaggaggctcagcctggagaa

SEQ ID NO: 684293 - DNA, 25 bp, Rattus norvegicus
ttgtcaggcacactgtgggatgcca

SEQ ID NO: 684294 - DNA, 25 bp, Rattus norvegicus
ttgtcaggcacagtgtgggatgcca

SEQ ID NO: 684295 - DNA, 25 bp, Rattus norvegicus
ttgtcaggcagtctaatctcagtgt

SEQ ID NO: 684296 - DNA, 25 bp, Rattus norvegicus
ttgtcaggcagtgtaatctcagtgt

SEQ ID NO: 684297 - DNA, 25 bp, Rattus norvegicus
ttgtcaggctaacgcagcagctccg

SEQ ID NO: 684298 - DNA, 25 bp, Rattus norvegicus
ttgtcaggctaaggcagcagctccg

SEQ ID NO: 684299 - DNA, 25 bp, Rattus norvegicus
ttgtcaggctttcgtggcaacctcc

SEQ ID NO: 684300 - DNA, 25 bp, Rattus norvegicus
ttgtcaggctttggtggcaacctcc

SEQ ID NO: 684301 - DNA, 25 bp, Rattus norvegicus
ttgtcagtcagaatggcagccagtg

SEQ ID NO: 684302 - DNA, 25 bp, Rattus norvegicus
ttgtcagtcagattggcagccagtg

SEQ ID NO: 684303 - DNA, 25 bp, Rattus norvegicus
ttgtcagtcagcagacgccacagag

SEQ ID NO: 684304 - DNA, 25 bp, Rattus norvegicus
ttgtcagtcagctgacgccacagag

SEQ ID NO: 684305 - DNA, 25 bp, Rattus norvegicus
ttgtcagtcatgaggtccaaggttc

SEQ ID NO: 684306 - DNA, 25 bp, Rattus norvegicus
ttgtcagtcatgtggtccaaggttc

SEQ ID NO: 684307 - DNA, 25 bp, Rattus norvegicus
ttgtcagtccgtagtcagcacaggt

SEQ ID NO: 684308 - DNA, 25 bp, Rattus norvegicus
ttgtcagtccgttgtcagcacaggt

SEQ ID NO: 684309 - DNA, 25 bp, Rattus norvegicus
ttgtcagtcttcacttgacggttta

SEQ ID NO: 684310 - DNA, 25 bp, Rattus norvegicus
ttgtcagtcttctcttgacggttta

SEQ ID NO: 684311 - DNA, 25 bp, Rattus norvegicus
ttgtcagtgatgagtacgagctcga

SEQ ID NO: 684312 - DNA, 25 bp, Rattus norvegicus
ttgtcagtgatgtgtacgagctcga

SEQ ID NO: 684313 - DNA, 25 bp, Rattus norvegicus
ttgtcagtgcccatggctccatgca

SEQ ID NO: 684314 - DNA, 25 bp, Rattus norvegicus
ttgtcagtgcccttggctccatgca

SEQ ID NO: 684315 - DNA, 25 bp, Rattus norvegicus
ttgtcagtgcctcatttcattagcc

SEQ ID NO: 684316 - DNA, 25 bp, Rattus norvegicus
ttgtcagtgcctgatttcattagcc

SEQ ID NO: 684317 - DNA, 25 bp, Rattus norvegicus
ttgtcataacagacgatatcgggta

SEQ ID NO: 684318 - DNA, 25 bp, Rattus norvegicus
ttgtcataacagtcgatatcgggta

SEQ ID NO: 684319 - DNA, 25 bp, Rattus norvegicus
ttgtcataagtcatggctctggagc

SEQ ID NO: 684320 - DNA, 25 bp, Rattus norvegicus
ttgtcataagtcttggctctggagc

SEQ ID NO: 684321 - DNA, 25 bp, Rattus norvegicus
ttgtcataatcactgtctttgcttc

SEQ ID NO: 684322 - DNA, 25 bp, Rattus norvegicus
ttgtcataatcagtgtctttgcttc

SEQ ID NO: 684323 - DNA, 25 bp, Rattus norvegicus
ttgtcatattacaaccacttgttgg

SEQ ID NO: 684324 - DNA, 25 bp, Rattus norvegicus
ttgtcatattactaccacttgttgg

SEQ ID NO: 684325 - DNA, 25 bp, Rattus norvegicus
ttgtcatcacacatgttacactcgc

SEQ ID NO: 684326 - DNA, 25 bp, Rattus norvegicus
ttgtcatcacacttgttacactcgc

SEQ ID NO: 684327 - DNA, 25 bp, Rattus norvegicus
ttgtcatccagccaggtttcttttt

SEQ ID NO: 684328 - DNA, 25 bp, Rattus norvegicus
ttgtcatccagcgaggtttcttttt

SEQ ID NO: 684329 - DNA, 25 bp, Rattus norvegicus
ttgtcatccattctgcgcattccat

SEQ ID NO: 684330 - DNA, 25 bp, Rattus norvegicus
ttgtcatccattgtgcgcattccat

SEQ ID NO: 684331 - DNA, 25 bp, Rattus norvegicus
ttgtcatcccagaggcagaggccga

SEQ ID NO: 684332 - DNA, 25 bp, Rattus norvegicus
ttgtcatcccagtggcagaggccga

SEQ ID NO: 684333 - DNA, 25 bp, Rattus norvegicus
ttgtcatccctcacatactatggac

SEQ ID NO: 684334 - DNA, 25 bp, Rattus norvegicus
ttgtcatccctctcatactatggac

SEQ ID NO: 684335 - DNA, 25 bp, Rattus norvegicus
ttgtcatcctccatttgcataacca

SEQ ID NO: 684336 - DNA, 25 bp, Rattus norvegicus
ttgtcatcctccttttgcataacca

SEQ ID NO: 684337 - DNA, 25 bp, Rattus norvegicus
ttgtcatccttccaaggcctgggtt

SEQ ID NO: 684338 - DNA, 25 bp, Rattus norvegicus
ttgtcatccttcgaaggcctgggtt

SEQ ID NO: 684339 - DNA, 25 bp, Rattus norvegicus
ttgtcatcctttaccttatcttcat

SEQ ID NO: 684340 - DNA, 25 bp, Rattus norvegicus
ttgtcatccttttccttatcttcat

SEQ ID NO: 684341 - DNA, 25 bp, Rattus norvegicus
ttgtcatctcttctgctggcagcca

SEQ ID NO: 684342 - DNA, 25 bp, Rattus norvegicus
ttgtcatctcttgtgctggcagcca

SEQ ID NO: 684343 - DNA, 25 bp, Rattus norvegicus
ttgtcatctgttaatacatttcccc

SEQ ID NO: 684344 - DNA, 25 bp, Rattus norvegicus
ttgtcatctgtttatacatttcccc

SEQ ID NO: 684345 - DNA, 25 bp, Rattus norvegicus
ttgtcatcttccacgatacactgga

SEQ ID NO: 684346 - DNA, 25 bp, Rattus norvegicus
ttgtcatcttcctcgatacactgga

SEQ ID NO: 684347 - DNA, 25 bp, Rattus norvegicus
ttgtcatcttgcatgcttcacttct

SEQ ID NO: 684348 - DNA, 25 bp, Rattus norvegicus
ttgtcatcttgcttgcttcacttct

SEQ ID NO: 684349 - DNA, 25 bp, Rattus norvegicus
ttgtcatcttgtattattgtcttaa

SEQ ID NO: 684350 - DNA, 25 bp, Rattus norvegicus
ttgtcatcttgttttattgtcttaa

SEQ ID NO: 684351 - DNA, 25 bp, Rattus norvegicus
ttgtcatgaactatatccgtaacct

SEQ ID NO: 684352 - DNA, 25 bp, Rattus norvegicus
ttgtcatgaactttatccgtaacct

SEQ ID NO: 684353 - DNA, 25 bp, Rattus norvegicus
ttgtcatgagtacctagaacccctg

SEQ ID NO: 684354 - DNA, 25 bp, Rattus norvegicus
ttgtcatgagtagctagaacccctg

SEQ ID NO: 684355 - DNA, 25 bp, Rattus norvegicus
ttgtcatgcagtacacttggcccag

SEQ ID NO: 684356 - DNA, 25 bp, Rattus norvegicus
ttgtcatgcagttcacttggcccag

SEQ ID NO: 684357 - DNA, 25 bp, Rattus norvegicus
ttgtcatgcatgattcccaacacag

SEQ ID NO: 684358 - DNA, 25 bp, Rattus norvegicus
ttgtcatgcatgtttcccaacacag

SEQ ID NO: 684359 - DNA, 25 bp, Rattus norvegicus
ttgtcatgctgtccctgtgaataac

SEQ ID NO: 684360 - DNA, 25 bp, Rattus norvegicus
ttgtcatgctgtgcctgtgaataac

SEQ ID NO: 684361 - DNA, 25 bp, Rattus norvegicus
ttgtcatggagcaattccatcctga

SEQ ID NO: 684362 - DNA, 25 bp, Rattus norvegicus
ttgtcatggagctattccatcctga

SEQ ID NO: 684363 - DNA, 25 bp, Rattus norvegicus
ttgtcatggtggaggattcctccaa

SEQ ID NO: 684364 - DNA, 25 bp, Rattus norvegicus
ttgtcatggtggtggattcctccaa

SEQ ID NO: 684365 - DNA, 25 bp, Rattus norvegicus
ttgtcatgttgaaagtgttagccac

SEQ ID NO: 684366 - DNA, 25 bp, Rattus norvegicus
ttgtcatgttgatagtgttagccac

SEQ ID NO: 684367 - DNA, 25 bp, Rattus norvegicus
ttgtcattagcgaggttccctgtaa

SEQ ID NO: 684368 - DNA, 25 bp, Rattus norvegicus
ttgtcattagcgtggttccctgtaa

SEQ ID NO: 684369 - DNA, 25 bp, Rattus norvegicus
ttgtcattagctctttccatcgaat

SEQ ID NO: 684370 - DNA, 25 bp, Rattus norvegicus
ttgtcattagctgtttccatcgaat

SEQ ID NO: 684371 - DNA, 25 bp, Rattus norvegicus
ttgtcattcaaaccggaataacaag

SEQ ID NO: 684372 - DNA, 25 bp, Rattus norvegicus
ttgtcattcaaagcggaataacaag

SEQ ID NO: 684373 - DNA, 25 bp, Rattus norvegicus
ttgtcattcaggcaccagcatttga

SEQ ID NO: 684374 - DNA, 25 bp, Rattus norvegicus
ttgtcattcagggaccagcatttga

SEQ ID NO: 684375 - DNA, 25 bp, Rattus norvegicus
ttgtcattcctaaccggtctgctga

SEQ ID NO: 684376 - DNA, 25 bp, Rattus norvegicus
ttgtcattcctatccggtctgctga

SEQ ID NO: 684377 - DNA, 25 bp, Rattus norvegicus
ttgtcattcctcagatctatccaga

SEQ ID NO: 684378 - DNA, 25 bp, Rattus norvegicus
ttgtcattcctctgatctatccaga

SEQ ID NO: 684379 - DNA, 25 bp, Rattus norvegicus
ttgtcattctgcctgatgtgttgtc

SEQ ID NO: 684380 - DNA, 25 bp, Rattus norvegicus
ttgtcattctgcgtgatgtgttgtc

SEQ ID NO: 684381 - DNA, 25 bp, Rattus norvegicus
ttgtcattctggacatctgctcctt

SEQ ID NO: 684382 - DNA, 25 bp, Rattus norvegicus
ttgtcattctggtcatctgctcctt

SEQ ID NO: 684383 - DNA, 25 bp, Rattus norvegicus
ttgtcattgacaatgtgccgcccaa

SEQ ID NO: 684384 - DNA, 25 bp, Rattus norvegicus
ttgtcattgacattgtgccgcccaa

SEQ ID NO: 684385 - DNA, 25 bp, Rattus norvegicus
ttgtcattgttgcttctttttctaa

SEQ ID NO: 684386 - DNA, 25 bp, Rattus norvegicus
ttgtcattgttggttctttttctaa

SEQ ID NO: 684387 - DNA, 25 bp, Rattus norvegicus
ttgtcatttcatcgctgtcattcac

SEQ ID NO: 684388 - DNA, 25 bp, Rattus norvegicus
ttgtcatttcatggctgtcattcac

SEQ ID NO: 684389 - DNA, 25 bp, Rattus norvegicus
ttgtcatttcccaattttctctcgt

SEQ ID NO: 684390 - DNA, 25 bp, Rattus norvegicus
ttgtcatttccctattttctctcgt

SEQ ID NO: 684391 - DNA, 25 bp, Rattus norvegicus
ttgtcatttgtcacctttttgttgc

SEQ ID NO: 684392 - DNA, 25 bp, Rattus norvegicus
ttgtcatttgtctcctttttgttgc

SEQ ID NO: 684393 - DNA, 25 bp, Rattus norvegicus
ttgtcatttgtgcagcctggagcct

SEQ ID NO: 684394 - DNA, 25 bp, Rattus norvegicus
ttgtcatttgtggagcctggagcct

SEQ ID NO: 684395 - DNA, 25 bp, Rattus norvegicus
ttgtcatttgttccactctgtgtgc

SEQ ID NO: 684396 - DNA, 25 bp, Rattus norvegicus
ttgtcatttgttgcactctgtgtgc

SEQ ID NO: 684397 - DNA, 25 bp, Rattus norvegicus
ttgtcattttcaagcctctgtcttc

SEQ ID NO: 684398 - DNA, 25 bp, Rattus norvegicus
ttgtcattttcatgcctctgtcttc

SEQ ID NO: 684399 - DNA, 25 bp, Rattus norvegicus
ttgtcattttccctgttttctgtcc

SEQ ID NO: 684400 - DNA, 25 bp, Rattus norvegicus
ttgtcattttccgtgttttctgtcc

SEQ ID NO: 684401 - DNA, 25 bp, Rattus norvegicus
ttgtccaaaagaccagctgctgtcc

SEQ ID NO: 684402 - DNA, 25 bp, Rattus norvegicus
ttgtccaaaagagcagctgctgtcc

SEQ ID NO: 684403 - DNA, 25 bp, Rattus norvegicus
ttgtccaaacaacgcctctgggact

SEQ ID NO: 684404 - DNA, 25 bp, Rattus norvegicus
ttgtccaaacaaggcctctgggact

SEQ ID NO: 684405 - DNA, 25 bp, Rattus norvegicus
ttgtccaacagaagaagccggtcct

SEQ ID NO: 684406 - DNA, 25 bp, Rattus norvegicus
ttgtccaacagatgaagccggtcct

SEQ ID NO: 684407 - DNA, 25 bp, Rattus norvegicus
ttgtccaacttgcttgtgttcagaa

SEQ ID NO: 684408 - DNA, 25 bp, Rattus norvegicus
ttgtccaacttggttgtgttcagaa

SEQ ID NO: 684409 - DNA, 25 bp, Rattus norvegicus
ttgtccaagactcgctaggcttttt

SEQ ID NO: 684410 - DNA, 25 bp, Rattus norvegicus
ttgtccaagactggctaggcttttt

SEQ ID NO: 684411 - DNA, 25 bp, Rattus norvegicus
ttgtccaagagtctcacccagtgat

SEQ ID NO: 684412 - DNA, 25 bp, Rattus norvegicus
ttgtccaagagtgtcacccagtgat

SEQ ID NO: 684413 - DNA, 25 bp, Rattus norvegicus
ttgtccaagctgaaaactccactgt

SEQ ID NO: 684414 - DNA, 25 bp, Rattus norvegicus
ttgtccaagctgtaaactccactgt

SEQ ID NO: 684415 - DNA, 25 bp, Rattus norvegicus
ttgtccaagcttaagatagtacctg

SEQ ID NO: 684416 - DNA, 25 bp, Rattus norvegicus
ttgtccaagctttagatagtacctg

SEQ ID NO: 684417 - DNA, 25 bp, Rattus norvegicus
ttgtccaattgaccacccagctgtg

SEQ ID NO: 684418 - DNA, 25 bp, Rattus norvegicus
ttgtccaattgagcacccagctgtg

SEQ ID NO: 684419 - DNA, 25 bp, Rattus norvegicus
ttgtccacagtaccttcctaactaa

SEQ ID NO: 684420 - DNA, 25 bp, Rattus norvegicus
ttgtccacagtagcttcctaactaa

SEQ ID NO: 684421 - DNA, 25 bp, Rattus norvegicus
ttgtccacagtcaaggaggtgccct

SEQ ID NO: 684422 - DNA, 25 bp, Rattus norvegicus
ttgtccacagtctaggaggtgccct

SEQ ID NO: 684423 - DNA, 25 bp, Rattus norvegicus
ttgtccacatcccaattcttagagt

SEQ ID NO: 684424 - DNA, 25 bp, Rattus norvegicus
ttgtccacatccgaattcttagagt

SEQ ID NO: 684425 - DNA, 25 bp, Rattus norvegicus
ttgtccaccaagaatttgttcaaga

SEQ ID NO: 684426 - DNA, 25 bp, Rattus norvegicus
ttgtccaccaagtatttgttcaaga

SEQ ID NO: 684427 - DNA, 25 bp, Rattus norvegicus
ttgtccacctgcctgtgtatatgta

SEQ ID NO: 684428 - DNA, 25 bp, Rattus norvegicus
ttgtccacctgcgtgtgtatatgta

SEQ ID NO: 684429 - DNA, 25 bp, Rattus norvegicus
ttgtccacggcaaacattaactccc

SEQ ID NO: 684430 - DNA, 25 bp, Rattus norvegicus
ttgtccacggcatacattaactccc

SEQ ID NO: 684431 - DNA, 25 bp, Rattus norvegicus
ttgtccagaagtatcaaagaccctt

SEQ ID NO: 684432 - DNA, 25 bp, Rattus norvegicus
ttgtccagaagtttcaaagaccctt

SEQ ID NO: 684433 - DNA, 25 bp, Rattus norvegicus
ttgtccagaatcatgcagaccggct

SEQ ID NO: 684434 - DNA, 25 bp, Rattus norvegicus
ttgtccagaatcttgcagaccggct

SEQ ID NO: 684435 - DNA, 25 bp, Rattus norvegicus
ttgtccagataaacttccgggtcga

SEQ ID NO: 684436 - DNA, 25 bp, Rattus norvegicus
ttgtccagataatcttccgggtcga

SEQ ID NO: 684437 - DNA, 25 bp, Rattus norvegicus
ttgtccagatttcacagcgtcagcc

SEQ ID NO: 684438 - DNA, 25 bp, Rattus norvegicus
ttgtccagatttgacagcgtcagcc

SEQ ID NO: 684439 - DNA, 25 bp, Rattus norvegicus
ttgtccagcaatattagtgtttaag

SEQ ID NO: 684440 - DNA, 25 bp, Rattus norvegicus
ttgtccagcaattttagtgtttaag

SEQ ID NO: 684441 - DNA, 25 bp, Rattus norvegicus
ttgtccaggacgagcgtgctcagca

SEQ ID NO: 684442 - DNA, 25 bp, Rattus norvegicus
ttgtccaggacgtgcgtgctcagca

SEQ ID NO: 684443 - DNA, 25 bp, Rattus norvegicus
ttgtccagtctcacaacaggcaaag

SEQ ID NO: 684444 - DNA, 25 bp, Rattus norvegicus
ttgtccagtctctcaacaggcaaag

SEQ ID NO: 684445 - DNA, 25 bp, Rattus norvegicus
ttgtccagtgtcatacagtcagccc

SEQ ID NO: 684446 - DNA, 25 bp, Rattus norvegicus
ttgtccagtgtcttacagtcagccc

SEQ ID NO: 684447 - DNA, 25 bp, Rattus norvegicus
ttgtccataaaccttagcgtgcctt

SEQ ID NO: 684448 - DNA, 25 bp, Rattus norvegicus
ttgtccataaacgttagcgtgcctt

SEQ ID NO: 684449 - DNA, 25 bp, Rattus norvegicus
ttgtccatagaacgtggtccttgaa

SEQ ID NO: 684450 - DNA, 25 bp, Rattus norvegicus
ttgtccatagaaggtggtccttgaa

SEQ ID NO: 684451 - DNA, 25 bp, Rattus norvegicus
ttgtccatcatccattttcaaaatg

SEQ ID NO: 684452 - DNA, 25 bp, Rattus norvegicus
ttgtccatcatcgattttcaaaatg

SEQ ID NO: 684453 - DNA, 25 bp, Rattus norvegicus
ttgtccatcattactttgagacgaa

SEQ ID NO: 684454 - DNA, 25 bp, Rattus norvegicus
ttgtccatcatttctttgagacgaa

SEQ ID NO: 684455 - DNA, 25 bp, Rattus norvegicus
ttgtccatctttctcattttgctca

SEQ ID NO: 684456 - DNA, 25 bp, Rattus norvegicus
ttgtccatctttgtcattttgctca

SEQ ID NO: 684457 - DNA, 25 bp, Rattus norvegicus
ttgtccatgcccacagttgatcagt

SEQ ID NO: 684458 - DNA, 25 bp, Rattus norvegicus
ttgtccatgccctcagttgatcagt

SEQ ID NO: 684459 - DNA, 25 bp, Rattus norvegicus
ttgtccatgctgacgtgcccattcc

SEQ ID NO: 684460 - DNA, 25 bp, Rattus norvegicus
ttgtccatgctgtcgtgcccattcc

SEQ ID NO: 684461 - DNA, 25 bp, Rattus norvegicus
ttgtccatgtgtctatcaacgatga

SEQ ID NO: 684462 - DNA, 25 bp, Rattus norvegicus
ttgtccatgtgtgtatcaacgatga

SEQ ID NO: 684463 - DNA, 25 bp, Rattus norvegicus
ttgtccattcaccacaggtttgggt

SEQ ID NO: 684464 - DNA, 25 bp, Rattus norvegicus
ttgtccattcacgacaggtttgggt

SEQ ID NO: 684465 - DNA, 25 bp, Rattus norvegicus
ttgtccattggtagtctttgttaga

SEQ ID NO: 684466 - DNA, 25 bp, Rattus norvegicus
ttgtccattggttgtctttgttaga

SEQ ID NO: 684467 - DNA, 25 bp, Rattus norvegicus
ttgtccatttcaaggacgctggcca

SEQ ID NO: 684468 - DNA, 25 bp, Rattus norvegicus
ttgtccatttcatggacgctggcca

SEQ ID NO: 684469 - DNA, 25 bp, Rattus norvegicus
ttgtccatttgtagggttgcttcca

SEQ ID NO: 684470 - DNA, 25 bp, Rattus norvegicus
ttgtccatttgttgggttgcttcca

SEQ ID NO: 684471 - DNA, 25 bp, Rattus norvegicus
ttgtcccaactccaacgatctcttt

SEQ ID NO: 684472 - DNA, 25 bp, Rattus norvegicus
ttgtcccaactcgaacgatctcttt

SEQ ID NO: 684473 - DNA, 25 bp, Rattus norvegicus
ttgtcccaagaacgctgagctccct

SEQ ID NO: 684474 - DNA, 25 bp, Rattus norvegicus
ttgtcccaagaaggctgagctccct

SEQ ID NO: 684475 - DNA, 25 bp, Rattus norvegicus
ttgtcccaagttcttaaggcacagg

SEQ ID NO: 684476 - DNA, 25 bp, Rattus norvegicus
ttgtcccaagttgttaaggcacagg

SEQ ID NO: 684477 - DNA, 25 bp, Rattus norvegicus
ttgtcccacactacagaagctgcgg

SEQ ID NO: 684478 - DNA, 25 bp, Rattus norvegicus
ttgtcccacacttcagaagctgcgg

SEQ ID NO: 684479 - DNA, 25 bp, Rattus norvegicus
ttgtcccacagacctgtttgttgtg

SEQ ID NO: 684480 - DNA, 25 bp, Rattus norvegicus
ttgtcccacagagctgtttgttgtg

SEQ ID NO: 684481 - DNA, 25 bp, Rattus norvegicus
ttgtcccaccctaaggagccagaat

SEQ ID NO: 684482 - DNA, 25 bp, Rattus norvegicus
ttgtcccacccttaggagccagaat

SEQ ID NO: 684483 - DNA, 25 bp, Rattus norvegicus
ttgtcccactcgcttactgatagca

SEQ ID NO: 684484 - DNA, 25 bp, Rattus norvegicus
ttgtcccactcggttactgatagca

SEQ ID NO: 684485 - DNA, 25 bp, Rattus norvegicus
ttgtcccagacgagattaaggctat

SEQ ID NO: 684486 - DNA, 25 bp, Rattus norvegicus
ttgtcccagacgtgattaaggctat

SEQ ID NO: 684487 - DNA, 25 bp, Rattus norvegicus
ttgtcccagataaagtcacagtcat

SEQ ID NO: 684488 - DNA, 25 bp, Rattus norvegicus
ttgtcccagatatagtcacagtcat

SEQ ID NO: 684489 - DNA, 25 bp, Rattus norvegicus
ttgtcccaggatccacctgtcatga

SEQ ID NO: 684490 - DNA, 25 bp, Rattus norvegicus
ttgtcccaggatgcacctgtcatga

SEQ ID NO: 684491 - DNA, 25 bp, Rattus norvegicus
ttgtcccagtagacaggaggagcag

SEQ ID NO: 684492 - DNA, 25 bp, Rattus norvegicus
ttgtcccagtagtcaggaggagcag

SEQ ID NO: 684493 - DNA, 25 bp, Rattus norvegicus
ttgtcccagtttccgaagcttgaat

SEQ ID NO: 684494 - DNA, 25 bp, Rattus norvegicus
ttgtcccagtttgcgaagcttgaat

SEQ ID NO: 684495 - DNA, 25 bp, Rattus norvegicus
ttgtcccataatataacccacccta

SEQ ID NO: 684496 - DNA, 25 bp, Rattus norvegicus
ttgtcccataatttaacccacccta

SEQ ID NO: 684497 - DNA, 25 bp, Rattus norvegicus
ttgtcccatcacagcttggctttgg

SEQ ID NO: 684498 - DNA, 25 bp, Rattus norvegicus
ttgtcccatcactgcttggctttgg

SEQ ID NO: 684499 - DNA, 25 bp, Rattus norvegicus
ttgtcccatggaaggctgatctatt

SEQ ID NO: 684500 - DNA, 25 bp, Rattus norvegicus
ttgtcccatggatggctgatctatt

SEQ ID NO: 684501 - DNA, 25 bp, Rattus norvegicus
ttgtcccatggcatggctgaatgtc

SEQ ID NO: 684502 - DNA, 25 bp, Rattus norvegicus
ttgtcccatggcttggctgaatgtc

SEQ ID NO: 684503 - DNA, 25 bp, Rattus norvegicus
ttgtccccaaagatattctgcagct

SEQ ID NO: 684504 - DNA, 25 bp, Rattus norvegicus
ttgtccccaaagttattctgcagct

SEQ ID NO: 684505 - DNA, 25 bp, Rattus norvegicus
ttgtccccaacaatcatgcctggaa

SEQ ID NO: 684506 - DNA, 25 bp, Rattus norvegicus
ttgtccccaacattcatgcctggaa

SEQ ID NO: 684507 - DNA, 25 bp, Rattus norvegicus
ttgtccccaatacctgcttaagtgg

SEQ ID NO: 684508 - DNA, 25 bp, Rattus norvegicus
ttgtccccaatagctgcttaagtgg

SEQ ID NO: 684509 - DNA, 25 bp, Rattus norvegicus
ttgtccccagaacccaagcttggaa

SEQ ID NO: 684510 - DNA, 25 bp, Rattus norvegicus
ttgtccccagaagccaagcttggaa

SEQ ID NO: 684511 - DNA, 25 bp, Rattus norvegicus
ttgtccccagcaccaggagagggct

SEQ ID NO: 684512 - DNA, 25 bp, Rattus norvegicus
ttgtccccagcagcaggagagggct

SEQ ID NO: 684513 - DNA, 25 bp, Rattus norvegicus
ttgtccccatcgaggccgaggagga

SEQ ID NO: 684514 - DNA, 25 bp, Rattus norvegicus
ttgtccccatcgtggccgaggagga

SEQ ID NO: 684515 - DNA, 25 bp, Rattus norvegicus
ttgtccccggcacccatggtgtggt

SEQ ID NO: 684516 - DNA, 25 bp, Rattus norvegicus
ttgtccccggcagccatggtgtggt

SEQ ID NO: 684517 - DNA, 25 bp, Rattus norvegicus
ttgtccccggctaaacagtgtgcag

SEQ ID NO: 684518 - DNA, 25 bp, Rattus norvegicus
ttgtccccggcttaacagtgtgcag

SEQ ID NO: 684519 - DNA, 25 bp, Rattus norvegicus
ttgtcccctaacctttctgaagatt

SEQ ID NO: 684520 - DNA, 25 bp, Rattus norvegicus
ttgtcccctaacgtttctgaagatt

SEQ ID NO: 684521 - DNA, 25 bp, Rattus norvegicus
ttgtcccctccaaacgctgttgtgc

SEQ ID NO: 684522 - DNA, 25 bp, Rattus norvegicus
ttgtcccctccatacgctgttgtgc

SEQ ID NO: 684523 - DNA, 25 bp, Rattus norvegicus
ttgtcccctgatcactaaactattg

SEQ ID NO: 684524 - DNA, 25 bp, Rattus norvegicus
ttgtcccctgatgactaaactattg

SEQ ID NO: 684525 - DNA, 25 bp, Rattus norvegicus
ttgtcccctgctacaggaaccagat

SEQ ID NO: 684526 - DNA, 25 bp, Rattus norvegicus
ttgtcccctgcttcaggaaccagat

SEQ ID NO: 684527 - DNA, 25 bp, Rattus norvegicus
ttgtcccctggcacaaatgtctaag

SEQ ID NO: 684528 - DNA, 25 bp, Rattus norvegicus
ttgtcccctggcctggatggtaaat

SEQ ID NO: 684529 - DNA, 25 bp, Rattus norvegicus
ttgtcccctggcgtggatggtaaat

SEQ ID NO: 684530 - DNA, 25 bp, Rattus norvegicus
ttgtcccctggctcaaatgtctaag

SEQ ID NO: 684531 - DNA, 25 bp, Rattus norvegicus
ttgtcccgagtgaacttcattggca

SEQ ID NO: 684532 - DNA, 25 bp, Rattus norvegicus
ttgtcccgagtgtacttcattggca

SEQ ID NO: 684533 - DNA, 25 bp, Rattus norvegicus
ttgtcccgatggctttacctcaatt

SEQ ID NO: 684534 - DNA, 25 bp, Rattus norvegicus
ttgtcccgatgggtttacctcaatt

SEQ ID NO: 684535 - DNA, 25 bp, Rattus norvegicus
ttgtcccgcaccaaaggcaagagga

SEQ ID NO: 684536 - DNA, 25 bp, Rattus norvegicus
ttgtcccgcacctaaggcaagagga

SEQ ID NO: 684537 - DNA, 25 bp, Rattus norvegicus
ttgtcccgctcaacaaaatgctcca

SEQ ID NO: 684538 - DNA, 25 bp, Rattus norvegicus
ttgtcccgctcatcaaaatgctcca

SEQ ID NO: 684539 - DNA, 25 bp, Rattus norvegicus
ttgtcccgtgtaagtttctgtgatc

SEQ ID NO: 684540 - DNA, 25 bp, Rattus norvegicus
ttgtcccgtgtatgtttctgtgatc

SEQ ID NO: 684541 - DNA, 25 bp, Rattus norvegicus
ttgtccctatcaaaatccttccaga

SEQ ID NO: 684542 - DNA, 25 bp, Rattus norvegicus
ttgtccctatcataatccttccaga

SEQ ID NO: 684543 - DNA, 25 bp, Rattus norvegicus
ttgtccctcagccatttcaatgttg

SEQ ID NO: 684544 - DNA, 25 bp, Rattus norvegicus
ttgtccctcagcgatttcaatgttg

SEQ ID NO: 684545 - DNA, 25 bp, Rattus norvegicus
ttgtccctcctcaatgtgtgtccat

SEQ ID NO: 684546 - DNA, 25 bp, Rattus norvegicus
ttgtccctcctcatgagaaggcgga

SEQ ID NO: 684547 - DNA, 25 bp, Rattus norvegicus
ttgtccctcctctatgtgtgtccat

SEQ ID NO: 684548 - DNA, 25 bp, Rattus norvegicus
ttgtccctcctcttgagaaggcgga

SEQ ID NO: 684549 - DNA, 25 bp, Rattus norvegicus
ttgtccctcggtcagagaggcccca

SEQ ID NO: 684550 - DNA, 25 bp, Rattus norvegicus
ttgtccctcggtgagagaggcccca

SEQ ID NO: 684551 - DNA, 25 bp, Rattus norvegicus
ttgtccctctctatggctctttcat

SEQ ID NO: 684552 - DNA, 25 bp, Rattus norvegicus
ttgtccctctctttggctctttcat

SEQ ID NO: 684553 - DNA, 25 bp, Rattus norvegicus
ttgtccctgaagctcttttgcaaga

SEQ ID NO: 684554 - DNA, 25 bp, Rattus norvegicus
ttgtccctgaaggtcttttgcaaga

SEQ ID NO: 684555 - DNA, 25 bp, Rattus norvegicus
ttgtccctgagcaccagaggcaaaa

SEQ ID NO: 684556 - DNA, 25 bp, Rattus norvegicus
ttgtccctgagctccagaggcaaaa

SEQ ID NO: 684557 - DNA, 25 bp, Rattus norvegicus
ttgtccctgcatatgttttagacag

SEQ ID NO: 684558 - DNA, 25 bp, Rattus norvegicus
ttgtccctgcatttgttttagacag

SEQ ID NO: 684559 - DNA, 25 bp, Rattus norvegicus
ttgtccctggttcgtacttggagaa

SEQ ID NO: 684560 - DNA, 25 bp, Rattus norvegicus
ttgtccctggttggtacttggagaa

SEQ ID NO: 684561 - DNA, 25 bp, Rattus norvegicus
ttgtccctgtatccctctggtcgta

SEQ ID NO: 684562 - DNA, 25 bp, Rattus norvegicus
ttgtccctgtatgcctctggtcgta

SEQ ID NO: 684563 - DNA, 25 bp, Rattus norvegicus
ttgtccctgtccatttcattgcgat

SEQ ID NO: 684564 - DNA, 25 bp, Rattus norvegicus
ttgtccctgtccttttcattgcgat

SEQ ID NO: 684565 - DNA, 25 bp, Rattus norvegicus
ttgtcccttcaaagccatcaggtga

SEQ ID NO: 684566 - DNA, 25 bp, Rattus norvegicus
ttgtcccttcaatgccatcaggtga

SEQ ID NO: 684567 - DNA, 25 bp, Rattus norvegicus
ttgtcccttctcactggtcaagcaa

SEQ ID NO: 684568 - DNA, 25 bp, Rattus norvegicus
ttgtcccttctctctggtcaagcaa

SEQ ID NO: 684569 - DNA, 25 bp, Rattus norvegicus
ttgtcccttgccacactgaatatag

SEQ ID NO: 684570 - DNA, 25 bp, Rattus norvegicus
ttgtcccttgcctcactgaatatag

SEQ ID NO: 684571 - DNA, 25 bp, Rattus norvegicus
ttgtcccttgcgaagcatggagagt

SEQ ID NO: 684572 - DNA, 25 bp, Rattus norvegicus
ttgtcccttgcgtagcatggagagt

SEQ ID NO: 684573 - DNA, 25 bp, Rattus norvegicus
ttgtccctttggctaaatatgcgaa

SEQ ID NO: 684574 - DNA, 25 bp, Rattus norvegicus
ttgtccctttggcttaccctgggag

SEQ ID NO: 684575 - DNA, 25 bp, Rattus norvegicus
ttgtccctttgggtaaatatgcgaa

SEQ ID NO: 684576 - DNA, 25 bp, Rattus norvegicus
ttgtccctttgggttaccctgggag

SEQ ID NO: 684577 - DNA, 25 bp, Rattus norvegicus
ttgtccctttgtccgttaggatatt

SEQ ID NO: 684578 - DNA, 25 bp, Rattus norvegicus
ttgtccctttgtgcgttaggatatt

SEQ ID NO: 684579 - DNA, 25 bp, Rattus norvegicus
ttgtcccttttactttctggtctga

SEQ ID NO: 684580 - DNA, 25 bp, Rattus norvegicus
ttgtcccttttagtttctggtctga

SEQ ID NO: 684581 - DNA, 25 bp, Rattus norvegicus
ttgtccgaaagtatacccctctggt

SEQ ID NO: 684582 - DNA, 25 bp, Rattus norvegicus
ttgtccgaaagtttacccctctggt

SEQ ID NO: 684583 - DNA, 25 bp, Rattus norvegicus
ttgtccgatgtcatggaatcactgg

SEQ ID NO: 684584 - DNA, 25 bp, Rattus norvegicus
ttgtccgatgtcttggaatcactgg

SEQ ID NO: 684585 - DNA, 25 bp, Rattus norvegicus
ttgtccgcaggtactggttacagaa

SEQ ID NO: 684586 - DNA, 25 bp, Rattus norvegicus
ttgtccgcaggttctggttacagaa

SEQ ID NO: 684587 - DNA, 25 bp, Rattus norvegicus
ttgtccgcctcaaactgggatgaga

SEQ ID NO: 684588 - DNA, 25 bp, Rattus norvegicus
ttgtccgcctcatactgggatgaga

SEQ ID NO: 684589 - DNA, 25 bp, Rattus norvegicus
ttgtccgtaactcacgtgcgtgtgt

SEQ ID NO: 684590 - DNA, 25 bp, Rattus norvegicus
ttgtccgtaactgacgtgcgtgtgt

SEQ ID NO: 684591 - DNA, 25 bp, Rattus norvegicus
ttgtccgtatcaaaggctgaccgta

SEQ ID NO: 684592 - DNA, 25 bp, Rattus norvegicus
ttgtccgtatcataggctgaccgta

SEQ ID NO: 684593 - DNA, 25 bp, Rattus norvegicus
ttgtccgtcgttcgtatgcagcaca

SEQ ID NO: 684594 - DNA, 25 bp, Rattus norvegicus
ttgtccgtcgttggtatgcagcaca

SEQ ID NO: 684595 - DNA, 25 bp, Rattus norvegicus
ttgtccgtgataaggagccccaggt

SEQ ID NO: 684596 - DNA, 25 bp, Rattus norvegicus
ttgtccgtgatatggagccccaggt

SEQ ID NO: 684597 - DNA, 25 bp, Rattus norvegicus
ttgtccgtgctgaaagaccccatag

SEQ ID NO: 684598 - DNA, 25 bp, Rattus norvegicus
ttgtccgtgctgtaagaccccatag

SEQ ID NO: 684599 - DNA, 25 bp, Rattus norvegicus
ttgtccgttgctcccaccatgtgaa

SEQ ID NO: 684600 - DNA, 25 bp, Rattus norvegicus
ttgtccgttgctgccaccatgtgaa

SEQ ID NO: 684601 - DNA, 25 bp, Rattus norvegicus
ttgtccgttggaccacctgagtagt

SEQ ID NO: 684602 - DNA, 25 bp, Rattus norvegicus
ttgtccgttggagcacctgagtagt

SEQ ID NO: 684603 - DNA, 25 bp, Rattus norvegicus
ttgtccgttgtgagctacttaccta

SEQ ID NO: 684604 - DNA, 25 bp, Rattus norvegicus
ttgtccgttgtgtgctacttaccta

SEQ ID NO: 684605 - DNA, 25 bp, Rattus norvegicus
ttgtcctaaacactttgctccatca

SEQ ID NO: 684606 - DNA, 25 bp, Rattus norvegicus
ttgtcctaaacagtttgctccatca

SEQ ID NO: 684607 - DNA, 25 bp, Rattus norvegicus
ttgtcctaacccctgagtgataaga

SEQ ID NO: 684608 - DNA, 25 bp, Rattus norvegicus
ttgtcctaacccgtgagtgataaga

SEQ ID NO: 684609 - DNA, 25 bp, Rattus norvegicus
ttgtcctaagacagagcagccggca

SEQ ID NO: 684610 - DNA, 25 bp, Rattus norvegicus
ttgtcctaagactgagcagccggca

SEQ ID NO: 684611 - DNA, 25 bp, Rattus norvegicus
ttgtcctacagcatgtggtgtctgt

SEQ ID NO: 684612 - DNA, 25 bp, Rattus norvegicus
ttgtcctacagcttgtggtgtctgt

SEQ ID NO: 684613 - DNA, 25 bp, Rattus norvegicus
ttgtcctactgaagatcttgtagtt

SEQ ID NO: 684614 - DNA, 25 bp, Rattus norvegicus
ttgtcctactgatgatcttgtagtt

SEQ ID NO: 684615 - DNA, 25 bp, Rattus norvegicus
ttgtcctagcagaggcaatcttttg

SEQ ID NO: 684616 - DNA, 25 bp, Rattus norvegicus
ttgtcctagcagtggcaatcttttg

SEQ ID NO: 684617 - DNA, 25 bp, Rattus norvegicus
ttgtcctagtagcaccaacagcaga

SEQ ID NO: 684618 - DNA, 25 bp, Rattus norvegicus
ttgtcctagtaggaccaacagcaga

SEQ ID NO: 684619 - DNA, 25 bp, Rattus norvegicus
ttgtcctagttcacaaagcagcctg

SEQ ID NO: 684620 - DNA, 25 bp, Rattus norvegicus
ttgtcctagttctcaaagcagcctg

SEQ ID NO: 684621 - DNA, 25 bp, Rattus norvegicus
ttgtcctcaagcatccacatgcgta

SEQ ID NO: 684622 - DNA, 25 bp, Rattus norvegicus
ttgtcctcaagcttccacatgcgta

SEQ ID NO: 684623 - DNA, 25 bp, Rattus norvegicus
ttgtcctcacctcagtgaaggctca

SEQ ID NO: 684624 - DNA, 25 bp, Rattus norvegicus
ttgtcctcacctgagtgaaggctca

SEQ ID NO: 684625 - DNA, 25 bp, Rattus norvegicus
ttgtcctcaggtcctgcacgggtgt

SEQ ID NO: 684626 - DNA, 25 bp, Rattus norvegicus
ttgtcctcaggtctctgtgttaggt

SEQ ID NO: 684627 - DNA, 25 bp, Rattus norvegicus
ttgtcctcaggtgctgcacgggtgt

SEQ ID NO: 684628 - DNA, 25 bp, Rattus norvegicus
ttgtcctcaggtgtctgtgttaggt

SEQ ID NO: 684629 - DNA, 25 bp, Rattus norvegicus
ttgtcctccagtatccatagtgata

SEQ ID NO: 684630 - DNA, 25 bp, Rattus norvegicus
ttgtcctccagtcagtgtttaagag

SEQ ID NO: 684631 - DNA, 25 bp, Rattus norvegicus
ttgtcctccagtctgctccgaagct

SEQ ID NO: 684632 - DNA, 25 bp, Rattus norvegicus
ttgtcctccagtgagtgtttaagag

SEQ ID NO: 684633 - DNA, 25 bp, Rattus norvegicus
ttgtcctccagtgtgctccgaagct

SEQ ID NO: 684634 - DNA, 25 bp, Rattus norvegicus
ttgtcctccagtttccatagtgata

SEQ ID NO: 684635 - DNA, 25 bp, Rattus norvegicus
ttgtcctcccggaaggccttgggcg

SEQ ID NO: 684636 - DNA, 25 bp, Rattus norvegicus
ttgtcctcccggtaggccttgggcg

SEQ ID NO: 684637 - DNA, 25 bp, Rattus norvegicus
ttgtcctccgagacacctagcaaca

SEQ ID NO: 684638 - DNA, 25 bp, Rattus norvegicus
ttgtcctccgagtcacctagcaaca

SEQ ID NO: 684639 - DNA, 25 bp, Rattus norvegicus
ttgtcctcctcccaagtgtccagaa

SEQ ID NO: 684640 - DNA, 25 bp, Rattus norvegicus
ttgtcctcctccgaagtgtccagaa

SEQ ID NO: 684641 - DNA, 25 bp, Rattus norvegicus
ttgtcctcctgcacagccttgaaat

SEQ ID NO: 684642 - DNA, 25 bp, Rattus norvegicus
ttgtcctcctgctcagccttgaaat

SEQ ID NO: 684643 - DNA, 25 bp, Rattus norvegicus
ttgtcctccttgctaccgtatcaag

SEQ ID NO: 684644 - DNA, 25 bp, Rattus norvegicus
ttgtcctccttggtaccgtatcaag

SEQ ID NO: 684645 - DNA, 25 bp, Rattus norvegicus
ttgtcctcgctcatcagtctgaagt

SEQ ID NO: 684646 - DNA, 25 bp, Rattus norvegicus
ttgtcctcgctcttcagtctgaagt

SEQ ID NO: 684647 - DNA, 25 bp, Rattus norvegicus
ttgtcctcgggcatctgtggctcgt

SEQ ID NO: 684648 - DNA, 25 bp, Rattus norvegicus
ttgtcctcgggcttctgtggctcgt

SEQ ID NO: 684649 - DNA, 25 bp, Rattus norvegicus
ttgtcctcgtcccaaaagacggcag

SEQ ID NO: 684650 - DNA, 25 bp, Rattus norvegicus
ttgtcctcgtccgaaaagacggcag

SEQ ID NO: 684651 - DNA, 25 bp, Rattus norvegicus
ttgtcctctgaccacatcgatgtgt

SEQ ID NO: 684652 - DNA, 25 bp, Rattus norvegicus
ttgtcctctgacgacatcgatgtgt

SEQ ID NO: 684653 - DNA, 25 bp, Rattus norvegicus
ttgtcctctgtccacataggtgctg

SEQ ID NO: 684654 - DNA, 25 bp, Rattus norvegicus
ttgtcctctgtcgacataggtgctg

SEQ ID NO: 684655 - DNA, 25 bp, Rattus norvegicus
ttgtcctctttcatctcttgagaat

SEQ ID NO: 684656 - DNA, 25 bp, Rattus norvegicus
ttgtcctctttcttctcttgagaat

SEQ ID NO: 684657 - DNA, 25 bp, Rattus norvegicus
ttgtcctctttgactgaatcctgac

SEQ ID NO: 684658 - DNA, 25 bp, Rattus norvegicus
ttgtcctctttgtctgaatcctgac

SEQ ID NO: 684659 - DNA, 25 bp, Rattus norvegicus
ttgtcctgaaccatgtcttgatact

SEQ ID NO: 684660 - DNA, 25 bp, Rattus norvegicus
ttgtcctgaaccttgtcttgatact

SEQ ID NO: 684661 - DNA, 25 bp, Rattus norvegicus
ttgtcctgactccagcgaaggtgag

SEQ ID NO: 684662 - DNA, 25 bp, Rattus norvegicus
ttgtcctgactcgagcgaaggtgag

SEQ ID NO: 684663 - DNA, 25 bp, Rattus norvegicus
ttgtcctgattcatgtcctgatagt

SEQ ID NO: 684664 - DNA, 25 bp, Rattus norvegicus
ttgtcctgattcttgtcctgatagt

SEQ ID NO: 684665 - DNA, 25 bp, Rattus norvegicus
ttgtcctgctctcggcccaaaggag

SEQ ID NO: 684666 - DNA, 25 bp, Rattus norvegicus
ttgtcctgctctgggcccaaaggag

SEQ ID NO: 684667 - DNA, 25 bp, Rattus norvegicus
ttgtcctgcttccattacgctaagt

SEQ ID NO: 684668 - DNA, 25 bp, Rattus norvegicus
ttgtcctgcttcgattacgctaagt

SEQ ID NO: 684669 - DNA, 25 bp, Rattus norvegicus
ttgtcctggagaactagtgaacgct

SEQ ID NO: 684670 - DNA, 25 bp, Rattus norvegicus
ttgtcctggagatctagtgaacgct

SEQ ID NO: 684671 - DNA, 25 bp, Rattus norvegicus
ttgtcctgggaaacaagcctgggtc

SEQ ID NO: 684672 - DNA, 25 bp, Rattus norvegicus
ttgtcctgggaatcaagcctgggtc

SEQ ID NO: 684673 - DNA, 25 bp, Rattus norvegicus
ttgtcctgggatactgccttaagcc

SEQ ID NO: 684674 - DNA, 25 bp, Rattus norvegicus
ttgtcctgggattctgccttaagcc

SEQ ID NO: 684675 - DNA, 25 bp, Rattus norvegicus
ttgtcctgggtcagctgtactgaga

SEQ ID NO: 684676 - DNA, 25 bp, Rattus norvegicus
ttgtcctgggtcatgtgattctcca

SEQ ID NO: 684677 - DNA, 25 bp, Rattus norvegicus
ttgtcctgggtctgctgtactgaga

SEQ ID NO: 684678 - DNA, 25 bp, Rattus norvegicus
ttgtcctgggtcttgtgattctcca

SEQ ID NO: 684679 - DNA, 25 bp, Rattus norvegicus
ttgtcctggtgcaaacatgggagct

SEQ ID NO: 684680 - DNA, 25 bp, Rattus norvegicus
ttgtcctggtgctaacatgggagct

SEQ ID NO: 684681 - DNA, 25 bp, Rattus norvegicus
ttgtcctgtatgatggatcctgatg

SEQ ID NO: 684682 - DNA, 25 bp, Rattus norvegicus
ttgtcctgtatgttggatcctgatg

SEQ ID NO: 684683 - DNA, 25 bp, Rattus norvegicus
ttgtcctgtcctaagtcaattaaac

SEQ ID NO: 684684 - DNA, 25 bp, Rattus norvegicus
ttgtcctgtccttagtcaattaaac

SEQ ID NO: 684685 - DNA, 25 bp, Rattus norvegicus
ttgtcctgtgacagactagcagtgt

SEQ ID NO: 684686 - DNA, 25 bp, Rattus norvegicus
ttgtcctgtgactgactagcagtgt

SEQ ID NO: 684687 - DNA, 25 bp, Rattus norvegicus
ttgtcctgttagagcccggttcgaa

SEQ ID NO: 684688 - DNA, 25 bp, Rattus norvegicus
ttgtcctgttagtgcccggttcgaa

SEQ ID NO: 684689 - DNA, 25 bp, Rattus norvegicus
ttgtccttaacaacctccaagatgc

SEQ ID NO: 684690 - DNA, 25 bp, Rattus norvegicus
ttgtccttaacatcctccaagatgc

SEQ ID NO: 684691 - DNA, 25 bp, Rattus norvegicus
ttgtccttaggaagggcctggccct

SEQ ID NO: 684692 - DNA, 25 bp, Rattus norvegicus
ttgtccttaggatgggcctggccct

SEQ ID NO: 684693 - DNA, 25 bp, Rattus norvegicus
ttgtccttataacctgctgtcagct

SEQ ID NO: 684694 - DNA, 25 bp, Rattus norvegicus
ttgtccttataagctgctgtcagct

SEQ ID NO: 684695 - DNA, 25 bp, Rattus norvegicus
ttgtccttcacgcttcagcaagata

SEQ ID NO: 684696 - DNA, 25 bp, Rattus norvegicus
ttgtccttcacggttcagcaagata

SEQ ID NO: 684697 - DNA, 25 bp, Rattus norvegicus
ttgtccttctggaacagctgtgtca

SEQ ID NO: 684698 - DNA, 25 bp, Rattus norvegicus
ttgtccttctggtacagctgtgtca

SEQ ID NO: 684699 - DNA, 25 bp, Rattus norvegicus
ttgtccttgcaaacttagcttcttg

SEQ ID NO: 684700 - DNA, 25 bp, Rattus norvegicus
ttgtccttgcaatcttagcttcttg

SEQ ID NO: 684701 - DNA, 25 bp, Rattus norvegicus
ttgtccttgccaattgagctgctga

SEQ ID NO: 684702 - DNA, 25 bp, Rattus norvegicus
ttgtccttgccatttgagctgctga

SEQ ID NO: 684703 - DNA, 25 bp, Rattus norvegicus
ttgtccttgctaattgtcctgttac

SEQ ID NO: 684704 - DNA, 25 bp, Rattus norvegicus
ttgtccttgctatttgtcctgttac

SEQ ID NO: 684705 - DNA, 25 bp, Rattus norvegicus
ttgtcctttctgataggacttcata

SEQ ID NO: 684706 - DNA, 25 bp, Rattus norvegicus
ttgtcctttctgttaggacttcata

SEQ ID NO: 684707 - DNA, 25 bp, Rattus norvegicus
ttgtcctttcttagtcacatgctgg

SEQ ID NO: 684708 - DNA, 25 bp, Rattus norvegicus
ttgtcctttctttgtcacatgctgg

SEQ ID NO: 684709 - DNA, 25 bp, Rattus norvegicus
ttgtcctttggtagcaagcagagaa

SEQ ID NO: 684710 - DNA, 25 bp, Rattus norvegicus
ttgtcctttggtctccccacgtatt

SEQ ID NO: 684711 - DNA, 25 bp, Rattus norvegicus
ttgtcctttggtgtccccacgtatt

SEQ ID NO: 684712 - DNA, 25 bp, Rattus norvegicus
ttgtcctttggttgcaagcagagaa

SEQ ID NO: 684713 - DNA, 25 bp, Rattus norvegicus
ttgtcctttgtcagtgtttctctac

SEQ ID NO: 684714 - DNA, 25 bp, Rattus norvegicus
ttgtcctttgtccagtggagcctat

SEQ ID NO: 684715 - DNA, 25 bp, Rattus norvegicus
ttgtcctttgtcgagtggagcctat

SEQ ID NO: 684716 - DNA, 25 bp, Rattus norvegicus
ttgtcctttgtctgtgtttctctac

SEQ ID NO: 684717 - DNA, 25 bp, Rattus norvegicus
ttgtcctttgttcttaagctctggg

SEQ ID NO: 684718 - DNA, 25 bp, Rattus norvegicus
ttgtcctttgttgttaagctctggg

SEQ ID NO: 684719 - DNA, 25 bp, Rattus norvegicus
ttgtccttttatcctcttgtgtatt

SEQ ID NO: 684720 - DNA, 25 bp, Rattus norvegicus
ttgtccttttatgctcttgtgtatt

SEQ ID NO: 684721 - DNA, 25 bp, Rattus norvegicus
ttgtccttttggatattgtcttttg

SEQ ID NO: 684722 - DNA, 25 bp, Rattus norvegicus
ttgtccttttggttattgtcttttg

SEQ ID NO: 684723 - DNA, 25 bp, Rattus norvegicus
ttgtcgaaccacatgccgttggctg

SEQ ID NO: 684724 - DNA, 25 bp, Rattus norvegicus
ttgtcgaaccacttgccgttggctg

SEQ ID NO: 684725 - DNA, 25 bp, Rattus norvegicus
ttgtcgagagctagggatttcagcc

SEQ ID NO: 684726 - DNA, 25 bp, Rattus norvegicus
ttgtcgagagcttgggatttcagcc

SEQ ID NO: 684727 - DNA, 25 bp, Rattus norvegicus
ttgtcgagcacgaatccggtgagga

SEQ ID NO: 684728 - DNA, 25 bp, Rattus norvegicus
ttgtcgagcacgtatccggtgagga

SEQ ID NO: 684729 - DNA, 25 bp, Rattus norvegicus
ttgtcgcaaggtctcggcaatttac

SEQ ID NO: 684730 - DNA, 25 bp, Rattus norvegicus
ttgtcgcaaggtgtcggcaatttac

SEQ ID NO: 684731 - DNA, 25 bp, Rattus norvegicus
ttgtcgcacacacttttaagtccct

SEQ ID NO: 684732 - DNA, 25 bp, Rattus norvegicus
ttgtcgcacacagttttaagtccct

SEQ ID NO: 684733 - DNA, 25 bp, Rattus norvegicus
ttgtcgcagcagatctgcccgggct

SEQ ID NO: 684734 - DNA, 25 bp, Rattus norvegicus
ttgtcgcagcagttctgcccgggct

SEQ ID NO: 684735 - DNA, 25 bp, Rattus norvegicus
ttgtcgcatagcatgctgggcccat

SEQ ID NO: 684736 - DNA, 25 bp, Rattus norvegicus
ttgtcgcatagcttgctgggcccat

SEQ ID NO: 684737 - DNA, 25 bp, Rattus norvegicus
ttgtcgccgcggctctccgactgtg

SEQ ID NO: 684738 - DNA, 25 bp, Rattus norvegicus
ttgtcgccgcgggtctccgactgtg

SEQ ID NO: 684739 - DNA, 25 bp, Rattus norvegicus
ttgtcgccgtctagggtttcctaat

SEQ ID NO: 684740 - DNA, 25 bp, Rattus norvegicus
ttgtcgccgtcttgggtttcctaat

SEQ ID NO: 684741 - DNA, 25 bp, Rattus norvegicus
ttgtcgcgcacccaaaggcaaggag

SEQ ID NO: 684742 - DNA, 25 bp, Rattus norvegicus
ttgtcgcgcaccgaaaggcaaggag

SEQ ID NO: 684743 - DNA, 25 bp, Rattus norvegicus
ttgtcgcttaccatggatgccttaa

SEQ ID NO: 684744 - DNA, 25 bp, Rattus norvegicus
ttgtcgcttaccttggatgccttaa

SEQ ID NO: 684745 - DNA, 25 bp, Rattus norvegicus
ttgtcggacagtaagtggcatagct

SEQ ID NO: 684746 - DNA, 25 bp, Rattus norvegicus
ttgtcggacagttagtggcatagct

SEQ ID NO: 684747 - DNA, 25 bp, Rattus norvegicus
ttgtcggaggtcaggatcccggaac

SEQ ID NO: 684748 - DNA, 25 bp, Rattus norvegicus
ttgtcggaggtctggatcccggaac

SEQ ID NO: 684749 - DNA, 25 bp, Rattus norvegicus
ttgtcggcagatcgtaatactcagc

SEQ ID NO: 684750 - DNA, 25 bp, Rattus norvegicus
ttgtcggcagatggtaatactcagc

SEQ ID NO: 684751 - DNA, 25 bp, Rattus norvegicus
ttgtcggccttaagtgggctccaca

SEQ ID NO: 684752 - DNA, 25 bp, Rattus norvegicus
ttgtcggccttatgtgggctccaca

SEQ ID NO: 684753 - DNA, 25 bp, Rattus norvegicus
ttgtcgggacccaaattgatctcag

SEQ ID NO: 684754 - DNA, 25 bp, Rattus norvegicus
ttgtcgggaccctaattgatctcag

SEQ ID NO: 684755 - DNA, 25 bp, Rattus norvegicus
ttgtcggtcacaccttcattctgcc

SEQ ID NO: 684756 - DNA, 25 bp, Rattus norvegicus
ttgtcggtcacagcttcattctgcc

SEQ ID NO: 684757 - DNA, 25 bp, Rattus norvegicus
ttgtcggtcatgcttttcagcacgt

SEQ ID NO: 684758 - DNA, 25 bp, Rattus norvegicus
ttgtcggtcatggttttcagcacgt

SEQ ID NO: 684759 - DNA, 25 bp, Rattus norvegicus
ttgtcggtgctcaaacacacttggt

SEQ ID NO: 684760 - DNA, 25 bp, Rattus norvegicus
ttgtcggtgctctaacacacttggt

SEQ ID NO: 684761 - DNA, 25 bp, Rattus norvegicus
ttgtcggtttctcctttctgaccaa

SEQ ID NO: 684762 - DNA, 25 bp, Rattus norvegicus
ttgtcggtttctgctttctgaccaa

SEQ ID NO: 684763 - DNA, 25 bp, Rattus norvegicus
ttgtcgtcccagaacttgtgaagct

SEQ ID NO: 684764 - DNA, 25 bp, Rattus norvegicus
ttgtcgtcccagtacttgtgaagct

SEQ ID NO: 684765 - DNA, 25 bp, Rattus norvegicus
ttgtcgtcctaacaacgctggtgaa

SEQ ID NO: 684766 - DNA, 25 bp, Rattus norvegicus
ttgtcgtcctaagaacgctggtgaa

SEQ ID NO: 684767 - DNA, 25 bp, Rattus norvegicus
ttgtcgtctccgatgtccggcagag

SEQ ID NO: 684768 - DNA, 25 bp, Rattus norvegicus
ttgtcgtctccgttgtccggcagag

SEQ ID NO: 684769 - DNA, 25 bp, Rattus norvegicus
ttgtcgtctgccattaagtcacctg

SEQ ID NO: 684770 - DNA, 25 bp, Rattus norvegicus
ttgtcgtctgcctttaagtcacctg

SEQ ID NO: 684771 - DNA, 25 bp, Rattus norvegicus
ttgtcgtgatggaggctacgttcct

SEQ ID NO: 684772 - DNA, 25 bp, Rattus norvegicus
ttgtcgtgatggtggctacgttcct

SEQ ID NO: 684773 - DNA, 25 bp, Rattus norvegicus
ttgtcgtgctgactctgaggcctga

SEQ ID NO: 684774 - DNA, 25 bp, Rattus norvegicus
ttgtcgtgctgagtctgaggcctga

SEQ ID NO: 684775 - DNA, 25 bp, Rattus norvegicus
ttgtcgtgtgtgctgttccgttaaa

SEQ ID NO: 684776 - DNA, 25 bp, Rattus norvegicus
ttgtcgtgtgtggtgttccgttaaa

SEQ ID NO: 684777 - DNA, 25 bp, Rattus norvegicus
ttgtcgttgtacagacggcggacct

SEQ ID NO: 684778 - DNA, 25 bp, Rattus norvegicus
ttgtcgttgtactgacggcggacct

SEQ ID NO: 684779 - DNA, 25 bp, Rattus norvegicus
ttgtcgtttcccatcaaatatgttt

SEQ ID NO: 684780 - DNA, 25 bp, Rattus norvegicus
ttgtcgtttcccttcaaatatgttt

SEQ ID NO: 684781 - DNA, 25 bp, Rattus norvegicus
ttgtctacagagatagtttcaggat

SEQ ID NO: 684782 - DNA, 25 bp, Rattus norvegicus
ttgtctacagagttagtttcaggat

SEQ ID NO: 684783 - DNA, 25 bp, Rattus norvegicus
ttgtctaccctaaccaagaatccat

SEQ ID NO: 684784 - DNA, 25 bp, Rattus norvegicus
ttgtctaccctatccaagaatccat

SEQ ID NO: 684785 - DNA, 25 bp, Rattus norvegicus
ttgtctaccgcccagttctaggtaa

SEQ ID NO: 684786 - DNA, 25 bp, Rattus norvegicus
ttgtctaccgccgagttctaggtaa

SEQ ID NO: 684787 - DNA, 25 bp, Rattus norvegicus
ttgtctaccttcactgcgaggtgta

SEQ ID NO: 684788 - DNA, 25 bp, Rattus norvegicus
ttgtctaccttctctgcgaggtgta

SEQ ID NO: 684789 - DNA, 25 bp, Rattus norvegicus
ttgtctacgacaatgctcaggtgaa

SEQ ID NO: 684790 - DNA, 25 bp, Rattus norvegicus
ttgtctacgacattgctcaggtgaa

SEQ ID NO: 684791 - DNA, 25 bp, Rattus norvegicus
ttgtctagagttatctttttgtaca

SEQ ID NO: 684792 - DNA, 25 bp, Rattus norvegicus
ttgtctagagttttctttttgtaca

SEQ ID NO: 684793 - DNA, 25 bp, Rattus norvegicus
ttgtctagccacaaccactgttatt

SEQ ID NO: 684794 - DNA, 25 bp, Rattus norvegicus
ttgtctagccactaccactgttatt

SEQ ID NO: 684795 - DNA, 25 bp, Rattus norvegicus
ttgtctagcccaagttcttcagatc

SEQ ID NO: 684796 - DNA, 25 bp, Rattus norvegicus
ttgtctagcccatgttcttcagatc

SEQ ID NO: 684797 - DNA, 25 bp, Rattus norvegicus
ttgtctagcttcacacacactgcag

SEQ ID NO: 684798 - DNA, 25 bp, Rattus norvegicus
ttgtctagcttctcacacactgcag

SEQ ID NO: 684799 - DNA, 25 bp, Rattus norvegicus
ttgtctagggcaagagttctctgag

SEQ ID NO: 684800 - DNA, 25 bp, Rattus norvegicus
ttgtctagggcatgagttctctgag

SEQ ID NO: 684801 - DNA, 25 bp, Rattus norvegicus
ttgtctaggtttaatttggaacctg

SEQ ID NO: 684802 - DNA, 25 bp, Rattus norvegicus
ttgtctaggttttatttggaacctg

SEQ ID NO: 684803 - DNA, 25 bp, Rattus norvegicus
ttgtctatcttaacttgccgagtca

SEQ ID NO: 684804 - DNA, 25 bp, Rattus norvegicus
ttgtctatcttatcttgccgagtca

SEQ ID NO: 684805 - DNA, 25 bp, Rattus norvegicus
ttgtctattgtaccgaaggcgtttt

SEQ ID NO: 684806 - DNA, 25 bp, Rattus norvegicus
ttgtctattgtagcgaaggcgtttt

SEQ ID NO: 684807 - DNA, 25 bp, Rattus norvegicus
ttgtctattgttaaaggatgttgcc

SEQ ID NO: 684808 - DNA, 25 bp, Rattus norvegicus
ttgtctattgtttaaggatgttgcc

SEQ ID NO: 684809 - DNA, 25 bp, Rattus norvegicus
ttgtctcaaaccaaacttgtcacgg

SEQ ID NO: 684810 - DNA, 25 bp, Rattus norvegicus
ttgtctcaaacctaacttgtcacgg

SEQ ID NO: 684811 - DNA, 25 bp, Rattus norvegicus
ttgtctcaactcaaagacgccgcat

SEQ ID NO: 684812 - DNA, 25 bp, Rattus norvegicus
ttgtctcaactctaagacgccgcat

SEQ ID NO: 684813 - DNA, 25 bp, Rattus norvegicus
ttgtctcaagacaagcttctgcctg

SEQ ID NO: 684814 - DNA, 25 bp, Rattus norvegicus
ttgtctcaagactagcttctgcctg

SEQ ID NO: 684815 - DNA, 25 bp, Rattus norvegicus
ttgtctcaatctatctccttaggtc

SEQ ID NO: 684816 - DNA, 25 bp, Rattus norvegicus
ttgtctcaatctttctccttaggtc

SEQ ID NO: 684817 - DNA, 25 bp, Rattus norvegicus
ttgtctcaccctcctgaaatgaatg

SEQ ID NO: 684818 - DNA, 25 bp, Rattus norvegicus
ttgtctcaccctgctgaaatgaatg

SEQ ID NO: 684819 - DNA, 25 bp, Rattus norvegicus
ttgtctcaccgccagaggagtctcc

SEQ ID NO: 684820 - DNA, 25 bp, Rattus norvegicus
ttgtctcaccgcgagaggagtctcc

SEQ ID NO: 684821 - DNA, 25 bp, Rattus norvegicus
ttgtctcactggaatcactcagtaa

SEQ ID NO: 684822 - DNA, 25 bp, Rattus norvegicus
ttgtctcactggtatcactcagtaa

SEQ ID NO: 684823 - DNA, 25 bp, Rattus norvegicus
ttgtctcactttaggccatagtctg

SEQ ID NO: 684824 - DNA, 25 bp, Rattus norvegicus
ttgtctcactttaggttgccaatat

SEQ ID NO: 684825 - DNA, 25 bp, Rattus norvegicus
ttgtctcacttttggccatagtctg

SEQ ID NO: 684826 - DNA, 25 bp, Rattus norvegicus
ttgtctcacttttggttgccaatat

SEQ ID NO: 684827 - DNA, 25 bp, Rattus norvegicus
ttgtctcagaacaggtcgcagcgag

SEQ ID NO: 684828 - DNA, 25 bp, Rattus norvegicus
ttgtctcagaactggtcgcagcgag

SEQ ID NO: 684829 - DNA, 25 bp, Rattus norvegicus
ttgtctcagacaccgcagttagtcc

SEQ ID NO: 684830 - DNA, 25 bp, Rattus norvegicus
ttgtctcagacagcgcagttagtcc

SEQ ID NO: 684831 - DNA, 25 bp, Rattus norvegicus
ttgtctcagcttccaggtatctggg

SEQ ID NO: 684832 - DNA, 25 bp, Rattus norvegicus
ttgtctcagcttgcaggtatctggg

SEQ ID NO: 684833 - DNA, 25 bp, Rattus norvegicus
ttgtctcaggatctccatatgctct

SEQ ID NO: 684834 - DNA, 25 bp, Rattus norvegicus
ttgtctcaggatgtccatatgctct

SEQ ID NO: 684835 - DNA, 25 bp, Rattus norvegicus
ttgtctcatctgcaataaccatgga

SEQ ID NO: 684836 - DNA, 25 bp, Rattus norvegicus
ttgtctcatctggaataaccatgga

SEQ ID NO: 684837 - DNA, 25 bp, Rattus norvegicus
ttgtctcatggtcaaattaatgtat

SEQ ID NO: 684838 - DNA, 25 bp, Rattus norvegicus
ttgtctcatggtgaaattaatgtat

SEQ ID NO: 684839 - DNA, 25 bp, Rattus norvegicus
ttgtctccaaataagaatcctgtgc

SEQ ID NO: 684840 - DNA, 25 bp, Rattus norvegicus
ttgtctccaaatctttcatccactc

SEQ ID NO: 684841 - DNA, 25 bp, Rattus norvegicus
ttgtctccaaatgtttcatccactc

SEQ ID NO: 684842 - DNA, 25 bp, Rattus norvegicus
ttgtctccaaattagaatcctgtgc

SEQ ID NO: 684843 - DNA, 25 bp, Rattus norvegicus
ttgtctccactcacataagaagaag

SEQ ID NO: 684844 - DNA, 25 bp, Rattus norvegicus
ttgtctccactctcataagaagaag

SEQ ID NO: 684845 - DNA, 25 bp, Rattus norvegicus
ttgtctccaggcctctgtcttaggc

SEQ ID NO: 684846 - DNA, 25 bp, Rattus norvegicus
ttgtctccaggcgtctgtcttaggc

SEQ ID NO: 684847 - DNA, 25 bp, Rattus norvegicus
ttgtctccagtgagcacataccatg

SEQ ID NO: 684848 - DNA, 25 bp, Rattus norvegicus
ttgtctccagtgtgcacataccatg

SEQ ID NO: 684849 - DNA, 25 bp, Rattus norvegicus
ttgtctccatctaaagaatccgctc

SEQ ID NO: 684850 - DNA, 25 bp, Rattus norvegicus
ttgtctccatcttaagaatccgctc

SEQ ID NO: 684851 - DNA, 25 bp, Rattus norvegicus
ttgtctcccaaccttgaatgggctg

SEQ ID NO: 684852 - DNA, 25 bp, Rattus norvegicus
ttgtctcccaacgttgaatgggctg

SEQ ID NO: 684853 - DNA, 25 bp, Rattus norvegicus
ttgtctcccagtagcaggtcgacca

SEQ ID NO: 684854 - DNA, 25 bp, Rattus norvegicus
ttgtctcccagttgcaggtcgacca

SEQ ID NO: 684855 - DNA, 25 bp, Rattus norvegicus
ttgtctcccctgagcactaggtgaa

SEQ ID NO: 684856 - DNA, 25 bp, Rattus norvegicus
ttgtctcccctgtgcactaggtgaa

SEQ ID NO: 684857 - DNA, 25 bp, Rattus norvegicus
ttgtctccctccaactggtattaaa

SEQ ID NO: 684858 - DNA, 25 bp, Rattus norvegicus
ttgtctccctcctactggtattaaa

SEQ ID NO: 684859 - DNA, 25 bp, Rattus norvegicus
ttgtctccctttattctgtcccatt

SEQ ID NO: 684860 - DNA, 25 bp, Rattus norvegicus
ttgtctcccttttttctgtcccatt

SEQ ID NO: 684861 - DNA, 25 bp, Rattus norvegicus
ttgtctcctaccacaagtatcatgt

SEQ ID NO: 684862 - DNA, 25 bp, Rattus norvegicus
ttgtctcctacctcaagtatcatgt

SEQ ID NO: 684863 - DNA, 25 bp, Rattus norvegicus
ttgtctcctcaaatacaaggcctgg

SEQ ID NO: 684864 - DNA, 25 bp, Rattus norvegicus
ttgtctcctcaacacgactggtaaa

SEQ ID NO: 684865 - DNA, 25 bp, Rattus norvegicus
ttgtctcctcaagacgactggtaaa

SEQ ID NO: 684866 - DNA, 25 bp, Rattus norvegicus
ttgtctcctcaattacaaggcctgg

SEQ ID NO: 684867 - DNA, 25 bp, Rattus norvegicus
ttgtctcctcagctctacggagcat

SEQ ID NO: 684868 - DNA, 25 bp, Rattus norvegicus
ttgtctcctcaggtctacggagcat

SEQ ID NO: 684869 - DNA, 25 bp, Rattus norvegicus
ttgtctcctccactgtgcagttttc

SEQ ID NO: 684870 - DNA, 25 bp, Rattus norvegicus
ttgtctcctccagtgtgcagttttc

SEQ ID NO: 684871 - DNA, 25 bp, Rattus norvegicus
ttgtctcctggacttgcagccagca

SEQ ID NO: 684872 - DNA, 25 bp, Rattus norvegicus
ttgtctcctggagttgcagccagca

SEQ ID NO: 684873 - DNA, 25 bp, Rattus norvegicus
ttgtctctagctactatcctactat

SEQ ID NO: 684874 - DNA, 25 bp, Rattus norvegicus
ttgtctctagcttctatcctactat

SEQ ID NO: 684875 - DNA, 25 bp, Rattus norvegicus
ttgtctctagtgctaattgctgcta

SEQ ID NO: 684876 - DNA, 25 bp, Rattus norvegicus
ttgtctctagtggtaattgctgcta

SEQ ID NO: 684877 - DNA, 25 bp, Rattus norvegicus
ttgtctctcctgaattctcttaaat

SEQ ID NO: 684878 - DNA, 25 bp, Rattus norvegicus
ttgtctctcctgatcatacctgttt

SEQ ID NO: 684879 - DNA, 25 bp, Rattus norvegicus
ttgtctctcctgtattctcttaaat

SEQ ID NO: 684880 - DNA, 25 bp, Rattus norvegicus
ttgtctctcctgttcatacctgttt

SEQ ID NO: 684881 - DNA, 25 bp, Rattus norvegicus
ttgtctctcgacaaaggaattctcc

SEQ ID NO: 684882 - DNA, 25 bp, Rattus norvegicus
ttgtctctcgactaaggaattctcc

SEQ ID NO: 684883 - DNA, 25 bp, Rattus norvegicus
ttgtctctcgagactctaactctag

SEQ ID NO: 684884 - DNA, 25 bp, Rattus norvegicus
ttgtctctcgagtctctaactctag

SEQ ID NO: 684885 - DNA, 25 bp, Rattus norvegicus
ttgtctctctagagcggttgtggct

SEQ ID NO: 684886 - DNA, 25 bp, Rattus norvegicus
ttgtctctctagtgcggttgtggct

SEQ ID NO: 684887 - DNA, 25 bp, Rattus norvegicus
ttgtctctgaccctggatggactga

SEQ ID NO: 684888 - DNA, 25 bp, Rattus norvegicus
ttgtctctgaccgtggatggactga

SEQ ID NO: 684889 - DNA, 25 bp, Rattus norvegicus
ttgtctctgcacacgttttgagatg

SEQ ID NO: 684890 - DNA, 25 bp, Rattus norvegicus
ttgtctctgcactcgttttgagatg

SEQ ID NO: 684891 - DNA, 25 bp, Rattus norvegicus
ttgtctctgctcctgtgcccaagaa

SEQ ID NO: 684892 - DNA, 25 bp, Rattus norvegicus
ttgtctctgctcgtgtgcccaagaa

SEQ ID NO: 684893 - DNA, 25 bp, Rattus norvegicus
ttgtctctgctgatcctggatacca

SEQ ID NO: 684894 - DNA, 25 bp, Rattus norvegicus
ttgtctctgctgttcctggatacca

SEQ ID NO: 684895 - DNA, 25 bp, Rattus norvegicus
ttgtctctgcttagtgcctgggaag

SEQ ID NO: 684896 - DNA, 25 bp, Rattus norvegicus
ttgtctctgcttcctgctgtgacca

SEQ ID NO: 684897 - DNA, 25 bp, Rattus norvegicus
ttgtctctgcttgctgctgtgacca

SEQ ID NO: 684898 - DNA, 25 bp, Rattus norvegicus
ttgtctctgctttgtgcctgggaag

SEQ ID NO: 684899 - DNA, 25 bp, Rattus norvegicus
ttgtctctgggaatgtgtttgtcac

SEQ ID NO: 684900 - DNA, 25 bp, Rattus norvegicus
ttgtctctgggattgtgtttgtcac

SEQ ID NO: 684901 - DNA, 25 bp, Rattus norvegicus
ttgtctctggttaatcttagcctct

SEQ ID NO: 684902 - DNA, 25 bp, Rattus norvegicus
ttgtctctggtttatcttagcctct

SEQ ID NO: 684903 - DNA, 25 bp, Rattus norvegicus
ttgtctctgtcaacacagtgtctag

SEQ ID NO: 684904 - DNA, 25 bp, Rattus norvegicus
ttgtctctgtcatcacagtgtctag

SEQ ID NO: 684905 - DNA, 25 bp, Rattus norvegicus
ttgtctctgtggctctagctggcta

SEQ ID NO: 684906 - DNA, 25 bp, Rattus norvegicus
ttgtctctgtgggtctagctggcta

SEQ ID NO: 684907 - DNA, 25 bp, Rattus norvegicus
ttgtctcttcggcttcacagataat

SEQ ID NO: 684908 - DNA, 25 bp, Rattus norvegicus
ttgtctcttcgggttcacagataat

SEQ ID NO: 684909 - DNA, 25 bp, Rattus norvegicus
ttgtctcttctcactgtgcaaaaag

SEQ ID NO: 684910 - DNA, 25 bp, Rattus norvegicus
ttgtctcttctctctgtgcaaaaag

SEQ ID NO: 684911 - DNA, 25 bp, Rattus norvegicus
ttgtctcttcttatctggtgtttgc

SEQ ID NO: 684912 - DNA, 25 bp, Rattus norvegicus
ttgtctcttcttttctggtgtttgc

SEQ ID NO: 684913 - DNA, 25 bp, Rattus norvegicus
ttgtctcttgacattgtacctctca

SEQ ID NO: 684914 - DNA, 25 bp, Rattus norvegicus
ttgtctcttgactttgtacctctca

SEQ ID NO: 684915 - DNA, 25 bp, Rattus norvegicus
ttgtctctttacaatcaacccacat

SEQ ID NO: 684916 - DNA, 25 bp, Rattus norvegicus
ttgtctctttactatcaacccacat

SEQ ID NO: 684917 - DNA, 25 bp, Rattus norvegicus
ttgtctctttggattccttgtgaaa

SEQ ID NO: 684918 - DNA, 25 bp, Rattus norvegicus
ttgtctctttggtttccttgtgaaa

SEQ ID NO: 684919 - DNA, 25 bp, Rattus norvegicus
ttgtctctttgtaccacagtaaaac

SEQ ID NO: 684920 - DNA, 25 bp, Rattus norvegicus
ttgtctctttgttccacagtaaaac

SEQ ID NO: 684921 - DNA, 25 bp, Rattus norvegicus
ttgtctgaactgaggctgtcttgca

SEQ ID NO: 684922 - DNA, 25 bp, Rattus norvegicus
ttgtctgaactgtggctgtcttgca

SEQ ID NO: 684923 - DNA, 25 bp, Rattus norvegicus
ttgtctgaataaccctgattgccct

SEQ ID NO: 684924 - DNA, 25 bp, Rattus norvegicus
ttgtctgaataagcctgattgccct

SEQ ID NO: 684925 - DNA, 25 bp, Rattus norvegicus
ttgtctgacagaaggccatacctag

SEQ ID NO: 684926 - DNA, 25 bp, Rattus norvegicus
ttgtctgacagatggccatacctag

SEQ ID NO: 684927 - DNA, 25 bp, Rattus norvegicus
ttgtctgacattaactgcggtctag

SEQ ID NO: 684928 - DNA, 25 bp, Rattus norvegicus
ttgtctgacatttactgcggtctag

SEQ ID NO: 684929 - DNA, 25 bp, Rattus norvegicus
ttgtctgaccaactctgttctctgt

SEQ ID NO: 684930 - DNA, 25 bp, Rattus norvegicus
ttgtctgaccaagtctgttctctgt

SEQ ID NO: 684931 - DNA, 25 bp, Rattus norvegicus
ttgtctgactgaagtcatgccccac

SEQ ID NO: 684932 - DNA, 25 bp, Rattus norvegicus
ttgtctgactgatgtcatgccccac

SEQ ID NO: 684933 - DNA, 25 bp, Rattus norvegicus
ttgtctgagagaagagagccccttt

SEQ ID NO: 684934 - DNA, 25 bp, Rattus norvegicus
ttgtctgagagatgagagccccttt

SEQ ID NO: 684935 - DNA, 25 bp, Rattus norvegicus
ttgtctgagccccatgctcagtgag

SEQ ID NO: 684936 - DNA, 25 bp, Rattus norvegicus
ttgtctgagcccgatgctcagtgag

SEQ ID NO: 684937 - DNA, 25 bp, Rattus norvegicus
ttgtctgagctgaccactcagttga

SEQ ID NO: 684938 - DNA, 25 bp, Rattus norvegicus
ttgtctgagctgtccactcagttga

SEQ ID NO: 684939 - DNA, 25 bp, Rattus norvegicus
ttgtctgagtgtcattcggtggctt

SEQ ID NO: 684940 - DNA, 25 bp, Rattus norvegicus
ttgtctgagtgtgattcggtggctt

SEQ ID NO: 684941 - DNA, 25 bp, Rattus norvegicus
ttgtctgatcatattcttcctagtg

SEQ ID NO: 684942 - DNA, 25 bp, Rattus norvegicus
ttgtctgatcattttcttcctagtg

SEQ ID NO: 684943 - DNA, 25 bp, Rattus norvegicus
ttgtctgattgactgagtgtctggt

SEQ ID NO: 684944 - DNA, 25 bp, Rattus norvegicus
ttgtctgattgagtgagtgtctggt

SEQ ID NO: 684945 - DNA, 25 bp, Rattus norvegicus
ttgtctgcaagtcatccaatacgcc

SEQ ID NO: 684946 - DNA, 25 bp, Rattus norvegicus
ttgtctgcaagtgatccaatacgcc

SEQ ID NO: 684947 - DNA, 25 bp, Rattus norvegicus
ttgtctgcactcatcttcaaggcac

SEQ ID NO: 684948 - DNA, 25 bp, Rattus norvegicus
ttgtctgcactcttcttcaaggcac

SEQ ID NO: 684949 - DNA, 25 bp, Rattus norvegicus
ttgtctgcagacctagagcctggca

SEQ ID NO: 684950 - DNA, 25 bp, Rattus norvegicus
ttgtctgcagacgtagagcctggca

SEQ ID NO: 684951 - DNA, 25 bp, Rattus norvegicus
ttgtctgcagccacaaagctgatgt

SEQ ID NO: 684952 - DNA, 25 bp, Rattus norvegicus
ttgtctgcagcctcaaagctgatgt

SEQ ID NO: 684953 - DNA, 25 bp, Rattus norvegicus
ttgtctgccatcaggactctagcag

SEQ ID NO: 684954 - DNA, 25 bp, Rattus norvegicus
ttgtctgccatctggactctagcag

SEQ ID NO: 684955 - DNA, 25 bp, Rattus norvegicus
ttgtctgccatgaatatgtgtttag

SEQ ID NO: 684956 - DNA, 25 bp, Rattus norvegicus
ttgtctgccatgtatatgtgtttag

SEQ ID NO: 684957 - DNA, 25 bp, Rattus norvegicus
ttgtctgccccaccgagtgggcaca

SEQ ID NO: 684958 - DNA, 25 bp, Rattus norvegicus
ttgtctgccccagcgagtgggcaca

SEQ ID NO: 684959 - DNA, 25 bp, Rattus norvegicus
ttgtctgccttcaatgggagaggaa

SEQ ID NO: 684960 - DNA, 25 bp, Rattus norvegicus
ttgtctgccttctatgggagaggaa

SEQ ID NO: 684961 - DNA, 25 bp, Rattus norvegicus
ttgtctgcggctaaactagcttgga

SEQ ID NO: 684962 - DNA, 25 bp, Rattus norvegicus
ttgtctgcggcttaactagcttgga

SEQ ID NO: 684963 - DNA, 25 bp, Rattus norvegicus
ttgtctgctctgactttagagccag

SEQ ID NO: 684964 - DNA, 25 bp, Rattus norvegicus
ttgtctgctctgtctttagagccag

SEQ ID NO: 684965 - DNA, 25 bp, Rattus norvegicus
ttgtctgctgaaagtaagcgccctc

SEQ ID NO: 684966 - DNA, 25 bp, Rattus norvegicus
ttgtctgctgaatgtaagcgccctc

SEQ ID NO: 684967 - DNA, 25 bp, Rattus norvegicus
ttgtctgctgagaatcatcttgaga

SEQ ID NO: 684968 - DNA, 25 bp, Rattus norvegicus
ttgtctgctgagtatcatcttgaga

SEQ ID NO: 684969 - DNA, 25 bp, Rattus norvegicus
ttgtctgcttagagatcagctttca

SEQ ID NO: 684970 - DNA, 25 bp, Rattus norvegicus
ttgtctgcttagtgatcagctttca

SEQ ID NO: 684971 - DNA, 25 bp, Rattus norvegicus
ttgtctgcttcaaccatcacatctg

SEQ ID NO: 684972 - DNA, 25 bp, Rattus norvegicus
ttgtctgcttcatccatcacatctg

SEQ ID NO: 684973 - DNA, 25 bp, Rattus norvegicus
ttgtctgcttgcctcatcattttct

SEQ ID NO: 684974 - DNA, 25 bp, Rattus norvegicus
ttgtctgcttgcgtcatcattttct

SEQ ID NO: 684975 - DNA, 25 bp, Rattus norvegicus
ttgtctggactgatacctagttagt

SEQ ID NO: 684976 - DNA, 25 bp, Rattus norvegicus
ttgtctggactgttacctagttagt

SEQ ID NO: 684977 - DNA, 25 bp, Rattus norvegicus
ttgtctggagtaaacgtgcacttct

SEQ ID NO: 684978 - DNA, 25 bp, Rattus norvegicus
ttgtctggagtatacgtgcacttct

SEQ ID NO: 684979 - DNA, 25 bp, Rattus norvegicus
ttgtctggcgttatggcaaacttag

SEQ ID NO: 684980 - DNA, 25 bp, Rattus norvegicus
ttgtctggcgttttggcaaacttag

SEQ ID NO: 684981 - DNA, 25 bp, Rattus norvegicus
ttgtctgggaagcaaaccttcaacc

SEQ ID NO: 684982 - DNA, 25 bp, Rattus norvegicus
ttgtctgggaaggaaaccttcaacc

SEQ ID NO: 684983 - DNA, 25 bp, Rattus norvegicus
ttgtctgggagcctattggcaccca

SEQ ID NO: 684984 - DNA, 25 bp, Rattus norvegicus
ttgtctgggagcgtattggcaccca

SEQ ID NO: 684985 - DNA, 25 bp, Rattus norvegicus
ttgtctgtaaagaggcctgtgtgcc

SEQ ID NO: 684986 - DNA, 25 bp, Rattus norvegicus
ttgtctgtaaagtggcctgtgtgcc

SEQ ID NO: 684987 - DNA, 25 bp, Rattus norvegicus
ttgtctgtaaccacagtccctagga

SEQ ID NO: 684988 - DNA, 25 bp, Rattus norvegicus
ttgtctgtaacctcagtccctagga

SEQ ID NO: 684989 - DNA, 25 bp, Rattus norvegicus
ttgtctgtaagccacacaagggcag

SEQ ID NO: 684990 - DNA, 25 bp, Rattus norvegicus
ttgtctgtaagcgacacaagggcag

SEQ ID NO: 684991 - DNA, 25 bp, Rattus norvegicus
ttgtctgtacctcgtgtgtatctga

SEQ ID NO: 684992 - DNA, 25 bp, Rattus norvegicus
ttgtctgtacctggtgtgtatctga

SEQ ID NO: 684993 - DNA, 25 bp, Rattus norvegicus
ttgtctgtactgctttccagagggt

SEQ ID NO: 684994 - DNA, 25 bp, Rattus norvegicus
ttgtctgtactggtttccagagggt

SEQ ID NO: 684995 - DNA, 25 bp, Rattus norvegicus
ttgtctgtagtcagcttctggtgca

SEQ ID NO: 684996 - DNA, 25 bp, Rattus norvegicus
ttgtctgtagtctgcttctggtgca

SEQ ID NO: 684997 - DNA, 25 bp, Rattus norvegicus
ttgtctgtatcacctcatgtctgtt

SEQ ID NO: 684998 - DNA, 25 bp, Rattus norvegicus
ttgtctgtatcagctcatgtctgtt

SEQ ID NO: 684999 - DNA, 25 bp, Rattus norvegicus
ttgtctgtattcatcccttcctgaa

SEQ ID NO: 685000 - DNA, 25 bp, Rattus norvegicus
ttgtctgtattcttcccttcctgaa

SEQ ID NO: 685001 - DNA, 25 bp, Rattus norvegicus
ttgtctgtcacacttgctagacgga

SEQ ID NO: 685002 - DNA, 25 bp, Rattus norvegicus
ttgtctgtcacagttgctagacgga

SEQ ID NO: 685003 - DNA, 25 bp, Rattus norvegicus
ttgtctgtcaccatgaactggaaag

SEQ ID NO: 685004 - DNA, 25 bp, Rattus norvegicus
ttgtctgtcaccttgaactggaaag

SEQ ID NO: 685005 - DNA, 25 bp, Rattus norvegicus
ttgtctgtcactatgtctgtcacta

SEQ ID NO: 685006 - DNA, 25 bp, Rattus norvegicus
ttgtctgtcactttgtctgtcacta

SEQ ID NO: 685007 - DNA, 25 bp, Rattus norvegicus
ttgtctgtcagtctttctatctcga

SEQ ID NO: 685008 - DNA, 25 bp, Rattus norvegicus
ttgtctgtcagtgtttctatctcga

SEQ ID NO: 685009 - DNA, 25 bp, Rattus norvegicus
ttgtctgtcatcacttgtctgctca

SEQ ID NO: 685010 - DNA, 25 bp, Rattus norvegicus
ttgtctgtcatctcttgtctgctca

SEQ ID NO: 685011 - DNA, 25 bp, Rattus norvegicus
ttgtctgtccccatcaataactgag

SEQ ID NO: 685012 - DNA, 25 bp, Rattus norvegicus
ttgtctgtccccattgatgaagcac

SEQ ID NO: 685013 - DNA, 25 bp, Rattus norvegicus
ttgtctgtccccttcaataactgag

SEQ ID NO: 685014 - DNA, 25 bp, Rattus norvegicus
ttgtctgtcccctttgatgaagcac

SEQ ID NO: 685015 - DNA, 25 bp, Rattus norvegicus
ttgtctgtccttaggccagatgtta

SEQ ID NO: 685016 - DNA, 25 bp, Rattus norvegicus
ttgtctgtccttcccctatatggat

SEQ ID NO: 685017 - DNA, 25 bp, Rattus norvegicus
ttgtctgtccttgccctatatggat

SEQ ID NO: 685018 - DNA, 25 bp, Rattus norvegicus
ttgtctgtcctttggccagatgtta

SEQ ID NO: 685019 - DNA, 25 bp, Rattus norvegicus
ttgtctgtctccaaacgcttgggat

SEQ ID NO: 685020 - DNA, 25 bp, Rattus norvegicus
ttgtctgtctcctaacgcttgggat

SEQ ID NO: 685021 - DNA, 25 bp, Rattus norvegicus
ttgtctgtctggactgcttcctgat

SEQ ID NO: 685022 - DNA, 25 bp, Rattus norvegicus
ttgtctgtctggtctgcttcctgat

SEQ ID NO: 685023 - DNA, 25 bp, Rattus norvegicus
ttgtctgtctgtattgcccattcca

SEQ ID NO: 685024 - DNA, 25 bp, Rattus norvegicus
ttgtctgtctgtcttaaggctcagc

SEQ ID NO: 685025 - DNA, 25 bp, Rattus norvegicus
ttgtctgtctgtgttaaggctcagc

SEQ ID NO: 685026 - DNA, 25 bp, Rattus norvegicus
ttgtctgtctgttttgcccattcca

SEQ ID NO: 685027 - DNA, 25 bp, Rattus norvegicus
ttgtctgtggaaaatcatctgatac

SEQ ID NO: 685028 - DNA, 25 bp, Rattus norvegicus
ttgtctgtggaatatcatctgatac

SEQ ID NO: 685029 - DNA, 25 bp, Rattus norvegicus
ttgtctgttagaacccttgccattt

SEQ ID NO: 685030 - DNA, 25 bp, Rattus norvegicus
ttgtctgttagatcccttgccattt

SEQ ID NO: 685031 - DNA, 25 bp, Rattus norvegicus
ttgtctgttccgatctaagagcgat

SEQ ID NO: 685032 - DNA, 25 bp, Rattus norvegicus
ttgtctgttccgttctaagagcgat

SEQ ID NO: 685033 - DNA, 25 bp, Rattus norvegicus
ttgtctgttctaattatttttccag

SEQ ID NO: 685034 - DNA, 25 bp, Rattus norvegicus
ttgtctgttctatttatttttccag

SEQ ID NO: 685035 - DNA, 25 bp, Rattus norvegicus
ttgtctgttttcatcatagccactt

SEQ ID NO: 685036 - DNA, 25 bp, Rattus norvegicus
ttgtctgttttcttcatagccactt

SEQ ID NO: 685037 - DNA, 25 bp, Rattus norvegicus
ttgtcttaatggaagtgcctcccgc

SEQ ID NO: 685038 - DNA, 25 bp, Rattus norvegicus
ttgtcttaatggtagtgcctcccgc

SEQ ID NO: 685039 - DNA, 25 bp, Rattus norvegicus
ttgtcttacacgactctcagggaaa

SEQ ID NO: 685040 - DNA, 25 bp, Rattus norvegicus
ttgtcttacacgtctctcagggaaa

SEQ ID NO: 685041 - DNA, 25 bp, Rattus norvegicus
ttgtcttacctccttcataaacatc

SEQ ID NO: 685042 - DNA, 25 bp, Rattus norvegicus
ttgtcttacctcgttcataaacatc

SEQ ID NO: 685043 - DNA, 25 bp, Rattus norvegicus
ttgtcttatcacaatccctgtagtc

SEQ ID NO: 685044 - DNA, 25 bp, Rattus norvegicus
ttgtcttatcactatccctgtagtc

SEQ ID NO: 685045 - DNA, 25 bp, Rattus norvegicus
ttgtcttatcagaaaactcctccct

SEQ ID NO: 685046 - DNA, 25 bp, Rattus norvegicus
ttgtcttatcagtaaactcctccct

SEQ ID NO: 685047 - DNA, 25 bp, Rattus norvegicus
ttgtcttcaacccaacagtcacact

SEQ ID NO: 685048 - DNA, 25 bp, Rattus norvegicus
ttgtcttcaaccgaacagtcacact

SEQ ID NO: 685049 - DNA, 25 bp, Rattus norvegicus
ttgtcttcactaaatggttccctac

SEQ ID NO: 685050 - DNA, 25 bp, Rattus norvegicus
ttgtcttcactatatggttccctac

SEQ ID NO: 685051 - DNA, 25 bp, Rattus norvegicus
ttgtcttcagtcatctggcccagaa

SEQ ID NO: 685052 - DNA, 25 bp, Rattus norvegicus
ttgtcttcagtcttctggcccagaa

SEQ ID NO: 685053 - DNA, 25 bp, Rattus norvegicus
ttgtcttccaccatagggtccacag

SEQ ID NO: 685054 - DNA, 25 bp, Rattus norvegicus
ttgtcttccaccttagggtccacag

SEQ ID NO: 685055 - DNA, 25 bp, Rattus norvegicus
ttgtcttccattaaaaactctgtga

SEQ ID NO: 685056 - DNA, 25 bp, Rattus norvegicus
ttgtcttccatttaaaactctgtga

SEQ ID NO: 685057 - DNA, 25 bp, Rattus norvegicus
ttgtcttccccgatgtttacataat

SEQ ID NO: 685058 - DNA, 25 bp, Rattus norvegicus
ttgtcttccccgttgtttacataat

SEQ ID NO: 685059 - DNA, 25 bp, Rattus norvegicus
ttgtcttcccctacgcatgtgtgtt

SEQ ID NO: 685060 - DNA, 25 bp, Rattus norvegicus
ttgtcttccccttcgcatgtgtgtt

SEQ ID NO: 685061 - DNA, 25 bp, Rattus norvegicus
ttgtcttcctttagctcctctggtt

SEQ ID NO: 685062 - DNA, 25 bp, Rattus norvegicus
ttgtcttccttttgctcctctggtt

SEQ ID NO: 685063 - DNA, 25 bp, Rattus norvegicus
ttgtcttctcaaagtggttctattt

SEQ ID NO: 685064 - DNA, 25 bp, Rattus norvegicus
ttgtcttctcaatgtggttctattt

SEQ ID NO: 685065 - DNA, 25 bp, Rattus norvegicus
ttgtcttctcttagctgttttgcta

SEQ ID NO: 685066 - DNA, 25 bp, Rattus norvegicus
ttgtcttctctttgctgttttgcta

SEQ ID NO: 685067 - DNA, 25 bp, Rattus norvegicus
ttgtcttctggtctgcttcgtgaac

SEQ ID NO: 685068 - DNA, 25 bp, Rattus norvegicus
ttgtcttctggtgtgcttcgtgaac

SEQ ID NO: 685069 - DNA, 25 bp, Rattus norvegicus
ttgtcttcttagctctttcttagtg

SEQ ID NO: 685070 - DNA, 25 bp, Rattus norvegicus
ttgtcttcttaggtctttcttagtg

SEQ ID NO: 685071 - DNA, 25 bp, Rattus norvegicus
ttgtcttcttgtatagataccactt

SEQ ID NO: 685072 - DNA, 25 bp, Rattus norvegicus
ttgtcttcttgtttagataccactt

SEQ ID NO: 685073 - DNA, 25 bp, Rattus norvegicus
ttgtcttgaagcctgccactttgaa

SEQ ID NO: 685074 - DNA, 25 bp, Rattus norvegicus
ttgtcttgaagcgtgccactttgaa

SEQ ID NO: 685075 - DNA, 25 bp, Rattus norvegicus
ttgtcttgaatcctagcattgccta

SEQ ID NO: 685076 - DNA, 25 bp, Rattus norvegicus
ttgtcttgaatcgtagcattgccta

SEQ ID NO: 685077 - DNA, 25 bp, Rattus norvegicus
ttgtcttgcccacgaagtgcattct

SEQ ID NO: 685078 - DNA, 25 bp, Rattus norvegicus
ttgtcttgcccaggaagtgcattct

SEQ ID NO: 685079 - DNA, 25 bp, Rattus norvegicus
ttgtcttgctctcccttagtcgatt

SEQ ID NO: 685080 - DNA, 25 bp, Rattus norvegicus
ttgtcttgctctgccttagtcgatt

SEQ ID NO: 685081 - DNA, 25 bp, Rattus norvegicus
ttgtcttggaagcatactctgtaac

SEQ ID NO: 685082 - DNA, 25 bp, Rattus norvegicus
ttgtcttggaaggatactctgtaac

SEQ ID NO: 685083 - DNA, 25 bp, Rattus norvegicus
ttgtcttggctcatgtacctgatga

SEQ ID NO: 685084 - DNA, 25 bp, Rattus norvegicus
ttgtcttggctcttgtacctgatga

SEQ ID NO: 685085 - DNA, 25 bp, Rattus norvegicus
ttgtcttgggcccactggtgctgta

SEQ ID NO: 685086 - DNA, 25 bp, Rattus norvegicus
ttgtcttgggccgactggtgctgta

SEQ ID NO: 685087 - DNA, 25 bp, Rattus norvegicus
ttgtcttgtcttatgtgggagggca

SEQ ID NO: 685088 - DNA, 25 bp, Rattus norvegicus
ttgtcttgtcttttgtgggagggca

SEQ ID NO: 685089 - DNA, 25 bp, Rattus norvegicus
ttgtcttgtgcaaagtttctccaac

SEQ ID NO: 685090 - DNA, 25 bp, Rattus norvegicus
ttgtcttgtgcatagtttctccaac

SEQ ID NO: 685091 - DNA, 25 bp, Rattus norvegicus
ttgtctttaagactgtatagtggca

SEQ ID NO: 685092 - DNA, 25 bp, Rattus norvegicus
ttgtctttaagagtgtatagtggca

SEQ ID NO: 685093 - DNA, 25 bp, Rattus norvegicus
ttgtctttactgctggaaatgttat

SEQ ID NO: 685094 - DNA, 25 bp, Rattus norvegicus
ttgtctttactggtggaaatgttat

SEQ ID NO: 685095 - DNA, 25 bp, Rattus norvegicus
ttgtctttatccatgactcagcttc

SEQ ID NO: 685096 - DNA, 25 bp, Rattus norvegicus
ttgtctttatccttgactcagcttc

SEQ ID NO: 685097 - DNA, 25 bp, Rattus norvegicus
ttgtctttatctcacaacccagagc

SEQ ID NO: 685098 - DNA, 25 bp, Rattus norvegicus
ttgtctttatctgacaacccagagc

SEQ ID NO: 685099 - DNA, 25 bp, Rattus norvegicus
ttgtctttatgcaatgtaccttact

SEQ ID NO: 685100 - DNA, 25 bp, Rattus norvegicus
ttgtctttatgctatgtaccttact

SEQ ID NO: 685101 - DNA, 25 bp, Rattus norvegicus
ttgtctttcccactactagtctctt

SEQ ID NO: 685102 - DNA, 25 bp, Rattus norvegicus
ttgtctttcccagtactagtctctt

SEQ ID NO: 685103 - DNA, 25 bp, Rattus norvegicus
ttgtctttcctcctcagaattctgt

SEQ ID NO: 685104 - DNA, 25 bp, Rattus norvegicus
ttgtctttcctcgtcagaattctgt

SEQ ID NO: 685105 - DNA, 25 bp, Rattus norvegicus
ttgtctttctctacaagatactatt

SEQ ID NO: 685106 - DNA, 25 bp, Rattus norvegicus
ttgtctttctcttcaagatactatt

SEQ ID NO: 685107 - DNA, 25 bp, Rattus norvegicus
ttgtctttgaaacacgtgtctcttg

SEQ ID NO: 685108 - DNA, 25 bp, Rattus norvegicus
ttgtctttgaaagacgtgtctcttg

SEQ ID NO: 685109 - DNA, 25 bp, Rattus norvegicus
ttgtctttgaagagcctcccacatc

SEQ ID NO: 685110 - DNA, 25 bp, Rattus norvegicus
ttgtctttgaagtgcctcccacatc

SEQ ID NO: 685111 - DNA, 25 bp, Rattus norvegicus
ttgtctttgagaccagggcacacct

SEQ ID NO: 685112 - DNA, 25 bp, Rattus norvegicus
ttgtctttgagagcagggcacacct

SEQ ID NO: 685113 - DNA, 25 bp, Rattus norvegicus
ttgtctttgagcactaaacctgttt

SEQ ID NO: 685114 - DNA, 25 bp, Rattus norvegicus
ttgtctttgagctctaaacctgttt

SEQ ID NO: 685115 - DNA, 25 bp, Rattus norvegicus
ttgtctttgccacatgtctccatga

SEQ ID NO: 685116 - DNA, 25 bp, Rattus norvegicus
ttgtctttgccagatgtctccatga

SEQ ID NO: 685117 - DNA, 25 bp, Rattus norvegicus
ttgtctttgccgcactgatggagta

SEQ ID NO: 685118 - DNA, 25 bp, Rattus norvegicus
ttgtctttgccggactgatggagta

SEQ ID NO: 685119 - DNA, 25 bp, Rattus norvegicus
ttgtctttgctacaactctctgtga

SEQ ID NO: 685120 - DNA, 25 bp, Rattus norvegicus
ttgtctttgctagaactctctgtga

SEQ ID NO: 685121 - DNA, 25 bp, Rattus norvegicus
ttgtcttttaaaactgtcagaacta

SEQ ID NO: 685122 - DNA, 25 bp, Rattus norvegicus
ttgtcttttaaatctgtcagaacta

SEQ ID NO: 685123 - DNA, 25 bp, Rattus norvegicus
ttgtcttttagcattcgggaccaaa

SEQ ID NO: 685124 - DNA, 25 bp, Rattus norvegicus
ttgtcttttagctttcgggaccaaa

SEQ ID NO: 685125 - DNA, 25 bp, Rattus norvegicus
ttgtcttttagtcagagtagccttc

SEQ ID NO: 685126 - DNA, 25 bp, Rattus norvegicus
ttgtcttttagtgagagtagccttc

SEQ ID NO: 685127 - DNA, 25 bp, Rattus norvegicus
ttgtcttttattattgcattttgga

SEQ ID NO: 685128 - DNA, 25 bp, Rattus norvegicus
ttgtcttttatttttgcattttgga

SEQ ID NO: 685129 - DNA, 25 bp, Rattus norvegicus
ttgtcttttcaaaggctgtattttc

SEQ ID NO: 685130 - DNA, 25 bp, Rattus norvegicus
ttgtcttttcaatggctgtattttc

SEQ ID NO: 685131 - DNA, 25 bp, Rattus norvegicus
ttgtcttttccaacaacacccatga

SEQ ID NO: 685132 - DNA, 25 bp, Rattus norvegicus
ttgtcttttccatcaacacccatga

SEQ ID NO: 685133 - DNA, 25 bp, Rattus norvegicus
ttgtcttttgacactcagctgtctg

SEQ ID NO: 685134 - DNA, 25 bp, Rattus norvegicus
ttgtcttttgactctcagctgtctg

SEQ ID NO: 685135 - DNA, 25 bp, Rattus norvegicus
ttgtctttttatccactacctttat

SEQ ID NO: 685136 - DNA, 25 bp, Rattus norvegicus
ttgtctttttatgcactacctttat

SEQ ID NO: 685137 - DNA, 25 bp, Rattus norvegicus
ttgtgaaacccacggccaggtactg

SEQ ID NO: 685138 - DNA, 25 bp, Rattus norvegicus
ttgtgaaacccagggccaggtactg

SEQ ID NO: 685139 - DNA, 25 bp, Rattus norvegicus
ttgtgaaacctcaaaggccaccctc

SEQ ID NO: 685140 - DNA, 25 bp, Rattus norvegicus
ttgtgaaacctctaaggccaccctc

SEQ ID NO: 685141 - DNA, 25 bp, Rattus norvegicus
ttgtgaacaaaaagtcccttgcgga

SEQ ID NO: 685142 - DNA, 25 bp, Rattus norvegicus
ttgtgaacaaaatgtcccttgcgga

SEQ ID NO: 685143 - DNA, 25 bp, Rattus norvegicus
ttgtgaacaatcagcccagtcctgg

SEQ ID NO: 685144 - DNA, 25 bp, Rattus norvegicus
ttgtgaacaatctgcccagtcctgg

SEQ ID NO: 685145 - DNA, 25 bp, Rattus norvegicus
ttgtgaacacttccccttaaatagt

SEQ ID NO: 685146 - DNA, 25 bp, Rattus norvegicus
ttgtgaacacttgcccttaaatagt

SEQ ID NO: 685147 - DNA, 25 bp, Rattus norvegicus
ttgtgaacagcaagccctcttagac

SEQ ID NO: 685148 - DNA, 25 bp, Rattus norvegicus
ttgtgaacagcatgccctcttagac

SEQ ID NO: 685149 - DNA, 25 bp, Rattus norvegicus
ttgtgaacatctatcccaggtcatg

SEQ ID NO: 685150 - DNA, 25 bp, Rattus norvegicus
ttgtgaacatctttcccaggtcatg

SEQ ID NO: 685151 - DNA, 25 bp, Rattus norvegicus
ttgtgaaccatgactcggagccagc

SEQ ID NO: 685152 - DNA, 25 bp, Rattus norvegicus
ttgtgaaccatgtctcggagccagc

SEQ ID NO: 685153 - DNA, 25 bp, Rattus norvegicus
ttgtgaaccgctacttccaagggaa

SEQ ID NO: 685154 - DNA, 25 bp, Rattus norvegicus
ttgtgaaccgcttcttccaagggaa

SEQ ID NO: 685155 - DNA, 25 bp, Rattus norvegicus
ttgtgaaccttgaaactctgctgtc

SEQ ID NO: 685156 - DNA, 25 bp, Rattus norvegicus
ttgtgaaccttgtaactctgctgtc

SEQ ID NO: 685157 - DNA, 25 bp, Rattus norvegicus
ttgtgaactagtcgccgggatcttc

SEQ ID NO: 685158 - DNA, 25 bp, Rattus norvegicus
ttgtgaactagtggccgggatcttc

SEQ ID NO: 685159 - DNA, 25 bp, Rattus norvegicus
ttgtgaactttgacctccctgtaaa

SEQ ID NO: 685160 - DNA, 25 bp, Rattus norvegicus
ttgtgaactttgtcctccctgtaaa

SEQ ID NO: 685161 - DNA, 25 bp, Rattus norvegicus
ttgtgaagcaagaggatgaccgtct

SEQ ID NO: 685162 - DNA, 25 bp, Rattus norvegicus
ttgtgaagcaagtggatgaccgtct

SEQ ID NO: 685163 - DNA, 25 bp, Rattus norvegicus
ttgtgaagccaacccctgagggagt

SEQ ID NO: 685164 - DNA, 25 bp, Rattus norvegicus
ttgtgaagccaagccctgagggagt

SEQ ID NO: 685165 - DNA, 25 bp, Rattus norvegicus
ttgtgaagccaccttatcagtcctt

SEQ ID NO: 685166 - DNA, 25 bp, Rattus norvegicus
ttgtgaagccacgttatcagtcctt

SEQ ID NO: 685167 - DNA, 25 bp, Rattus norvegicus
ttgtgaagctgcatggcggtccctg

SEQ ID NO: 685168 - DNA, 25 bp, Rattus norvegicus
ttgtgaagctgcttggcggtccctg

SEQ ID NO: 685169 - DNA, 25 bp, Rattus norvegicus
ttgtgaagtcaacatgtgggcctgt

SEQ ID NO: 685170 - DNA, 25 bp, Rattus norvegicus
ttgtgaagtcaagatgtgggcctgt

SEQ ID NO: 685171 - DNA, 25 bp, Rattus norvegicus
ttgtgaagtccaaggttcccagctg

SEQ ID NO: 685172 - DNA, 25 bp, Rattus norvegicus
ttgtgaagtccatggttcccagctg

SEQ ID NO: 685173 - DNA, 25 bp, Rattus norvegicus
ttgtgaagtcgcaaacaggaccaag

SEQ ID NO: 685174 - DNA, 25 bp, Rattus norvegicus
ttgtgaagtcgctaacaggaccaag

SEQ ID NO: 685175 - DNA, 25 bp, Rattus norvegicus
ttgtgaatgaaactgctcttgctga

SEQ ID NO: 685176 - DNA, 25 bp, Rattus norvegicus
ttgtgaatgaaagtgctcttgctga

SEQ ID NO: 685177 - DNA, 25 bp, Rattus norvegicus
ttgtgaatgccaaccagcttgccca

SEQ ID NO: 685178 - DNA, 25 bp, Rattus norvegicus
ttgtgaatgccatccagcttgccca

SEQ ID NO: 685179 - DNA, 25 bp, Rattus norvegicus
ttgtgaattaacatgcctctcctca

SEQ ID NO: 685180 - DNA, 25 bp, Rattus norvegicus
ttgtgaattaacttgcctctcctca

SEQ ID NO: 685181 - DNA, 25 bp, Rattus norvegicus
ttgtgaatttcacagggtctcctgt

SEQ ID NO: 685182 - DNA, 25 bp, Rattus norvegicus
ttgtgaatttcagagggtctcctgt

SEQ ID NO: 685183 - DNA, 25 bp, Rattus norvegicus
ttgtgacaagagatgccaccgaagc

SEQ ID NO: 685184 - DNA, 25 bp, Rattus norvegicus
ttgtgacaagagttgccaccgaagc

SEQ ID NO: 685185 - DNA, 25 bp, Rattus norvegicus
ttgtgacaaggcaatcctgccacga

SEQ ID NO: 685186 - DNA, 25 bp, Rattus norvegicus
ttgtgacaaggctatcctgccacga

SEQ ID NO: 685187 - DNA, 25 bp, Rattus norvegicus
ttgtgacaaggtacccactgggtaa

SEQ ID NO: 685188 - DNA, 25 bp, Rattus norvegicus
ttgtgacaaggttcccactgggtaa

SEQ ID NO: 685189 - DNA, 25 bp, Rattus norvegicus
ttgtgacaagtcacccaagtctggt

SEQ ID NO: 685190 - DNA, 25 bp, Rattus norvegicus
ttgtgacaagtctcccaagtctggt

SEQ ID NO: 685191 - DNA, 25 bp, Rattus norvegicus
ttgtgacaatatctccatccatggc

SEQ ID NO: 685192 - DNA, 25 bp, Rattus norvegicus
ttgtgacaatatgtccatccatggc

SEQ ID NO: 685193 - DNA, 25 bp, Rattus norvegicus
ttgtgacacacacacagctagctat

SEQ ID NO: 685194 - DNA, 25 bp, Rattus norvegicus
ttgtgacacacagacagctagctat

SEQ ID NO: 685195 - DNA, 25 bp, Rattus norvegicus
ttgtgacacaggcaacatctcaatt

SEQ ID NO: 685196 - DNA, 25 bp, Rattus norvegicus
ttgtgacacagggaacatctcaatt

SEQ ID NO: 685197 - DNA, 25 bp, Rattus norvegicus
ttgtgacaccagcactaaccacggt

SEQ ID NO: 685198 - DNA, 25 bp, Rattus norvegicus
ttgtgacaccaggactaaccacggt

SEQ ID NO: 685199 - DNA, 25 bp, Rattus norvegicus
ttgtgacagaagactgttgcctgct

SEQ ID NO: 685200 - DNA, 25 bp, Rattus norvegicus
ttgtgacagaagtctgttgcctgct

SEQ ID NO: 685201 - DNA, 25 bp, Rattus norvegicus
ttgtgacagagaacacagacagaca

SEQ ID NO: 685202 - DNA, 25 bp, Rattus norvegicus
ttgtgacagagatcacagacagaca

SEQ ID NO: 685203 - DNA, 25 bp, Rattus norvegicus
ttgtgacagatcagccatctcgagg

SEQ ID NO: 685204 - DNA, 25 bp, Rattus norvegicus
ttgtgacagatctgccatctcgagg

SEQ ID NO: 685205 - DNA, 25 bp, Rattus norvegicus
ttgtgacatctgaggatgtaactga

SEQ ID NO: 685206 - DNA, 25 bp, Rattus norvegicus
ttgtgacatctgtggatgtaactga

SEQ ID NO: 685207 - DNA, 25 bp, Rattus norvegicus
ttgtgacatcttacccactcagtta

SEQ ID NO: 685208 - DNA, 25 bp, Rattus norvegicus
ttgtgacatctttcccactcagtta

SEQ ID NO: 685209 - DNA, 25 bp, Rattus norvegicus
ttgtgacatgccctctgactgccaa

SEQ ID NO: 685210 - DNA, 25 bp, Rattus norvegicus
ttgtgacatgccgtctgactgccaa

SEQ ID NO: 685211 - DNA, 25 bp, Rattus norvegicus
ttgtgacattccaagttgacttttt

SEQ ID NO: 685212 - DNA, 25 bp, Rattus norvegicus
ttgtgacattcctagttgacttttt

SEQ ID NO: 685213 - DNA, 25 bp, Rattus norvegicus
ttgtgacatttgcttgagtgccaat

SEQ ID NO: 685214 - DNA, 25 bp, Rattus norvegicus
ttgtgacatttggttgagtgccaat

SEQ ID NO: 685215 - DNA, 25 bp, Rattus norvegicus
ttgtgaccaaacagactgagcggat

SEQ ID NO: 685216 - DNA, 25 bp, Rattus norvegicus
ttgtgaccaaactgactgagcggat

SEQ ID NO: 685217 - DNA, 25 bp, Rattus norvegicus
ttgtgaccaagccaggccatattat

SEQ ID NO: 685218 - DNA, 25 bp, Rattus norvegicus
ttgtgaccaagcgaggccatattat

SEQ ID NO: 685219 - DNA, 25 bp, Rattus norvegicus
ttgtgaccaattctgccccgtagga

SEQ ID NO: 685220 - DNA, 25 bp, Rattus norvegicus
ttgtgaccaattgtgccccgtagga

SEQ ID NO: 685221 - DNA, 25 bp, Rattus norvegicus
ttgtgaccatgtctccttgggcaaa

SEQ ID NO: 685222 - DNA, 25 bp, Rattus norvegicus
ttgtgaccatgtgtccttgggcaaa

SEQ ID NO: 685223 - DNA, 25 bp, Rattus norvegicus
ttgtgaccattcagtgtttaccctc

SEQ ID NO: 685224 - DNA, 25 bp, Rattus norvegicus
ttgtgaccattctgtgtttaccctc

SEQ ID NO: 685225 - DNA, 25 bp, Rattus norvegicus
ttgtgacccgcccaattgtccggaa

SEQ ID NO: 685226 - DNA, 25 bp, Rattus norvegicus
ttgtgacccgccgaattgtccggaa

SEQ ID NO: 685227 - DNA, 25 bp, Rattus norvegicus
ttgtgaccctacaacatccagagat

SEQ ID NO: 685228 - DNA, 25 bp, Rattus norvegicus
ttgtgaccctactacatccagagat

SEQ ID NO: 685229 - DNA, 25 bp, Rattus norvegicus
ttgtgacctatcctgtggccttgca

SEQ ID NO: 685230 - DNA, 25 bp, Rattus norvegicus
ttgtgacctatcgtgtggccttgca

SEQ ID NO: 685231 - DNA, 25 bp, Rattus norvegicus
ttgtgacctcaaacgcacaccgagg

SEQ ID NO: 685232 - DNA, 25 bp, Rattus norvegicus
ttgtgacctcaaactttccttcaac

SEQ ID NO: 685233 - DNA, 25 bp, Rattus norvegicus
ttgtgacctcaatcgcacaccgagg

SEQ ID NO: 685234 - DNA, 25 bp, Rattus norvegicus
ttgtgacctcaatctttccttcaac

SEQ ID NO: 685235 - DNA, 25 bp, Rattus norvegicus
ttgtgacctcctcgagcagcgagac

SEQ ID NO: 685236 - DNA, 25 bp, Rattus norvegicus
ttgtgacctcctggagcagcgagac

SEQ ID NO: 685237 - DNA, 25 bp, Rattus norvegicus
ttgtgacctctgcatgtgccaggcg

SEQ ID NO: 685238 - DNA, 25 bp, Rattus norvegicus
ttgtgacctctggatgtgccaggcg

SEQ ID NO: 685239 - DNA, 25 bp, Rattus norvegicus
ttgtgacctttgatggcggcgtgca

SEQ ID NO: 685240 - DNA, 25 bp, Rattus norvegicus
ttgtgacctttgttggcggcgtgca

SEQ ID NO: 685241 - DNA, 25 bp, Rattus norvegicus
ttgtgacgccaccaaggctacggga

SEQ ID NO: 685242 - DNA, 25 bp, Rattus norvegicus
ttgtgacgccacgaaggctacggga

SEQ ID NO: 685243 - DNA, 25 bp, Rattus norvegicus
ttgtgacgtcggaaccttcatgaat

SEQ ID NO: 685244 - DNA, 25 bp, Rattus norvegicus
ttgtgacgtcggtaccttcatgaat

SEQ ID NO: 685245 - DNA, 25 bp, Rattus norvegicus
ttgtgactacaccagcaagccctgt

SEQ ID NO: 685246 - DNA, 25 bp, Rattus norvegicus
ttgtgactacacgagcaagccctgt

SEQ ID NO: 685247 - DNA, 25 bp, Rattus norvegicus
ttgtgactatgaagattgtgcctct

SEQ ID NO: 685248 - DNA, 25 bp, Rattus norvegicus
ttgtgactatgatgattgtgcctct

SEQ ID NO: 685249 - DNA, 25 bp, Rattus norvegicus
ttgtgactatgcagaccttgtggga

SEQ ID NO: 685250 - DNA, 25 bp, Rattus norvegicus
ttgtgactatgctgaccttgtggga

SEQ ID NO: 685251 - DNA, 25 bp, Rattus norvegicus
ttgtgactgccgagcccactaaggt

SEQ ID NO: 685252 - DNA, 25 bp, Rattus norvegicus
ttgtgactgccgtgcccactaaggt

SEQ ID NO: 685253 - DNA, 25 bp, Rattus norvegicus
ttgtgactgcggagggagaatcccc

SEQ ID NO: 685254 - DNA, 25 bp, Rattus norvegicus
ttgtgactgcggtgggagaatcccc

SEQ ID NO: 685255 - DNA, 25 bp, Rattus norvegicus
ttgtgactggcaatctgtccttcga

SEQ ID NO: 685256 - DNA, 25 bp, Rattus norvegicus
ttgtgactggcattctgtccttcga

SEQ ID NO: 685257 - DNA, 25 bp, Rattus norvegicus
ttgtgactgtcaccaatctttccct

SEQ ID NO: 685258 - DNA, 25 bp, Rattus norvegicus
ttgtgactgtcagcaatctttccct

SEQ ID NO: 685259 - DNA, 25 bp, Rattus norvegicus
ttgtgacttcatcctttctcaatgc

SEQ ID NO: 685260 - DNA, 25 bp, Rattus norvegicus
ttgtgacttcatgctttctcaatgc

SEQ ID NO: 685261 - DNA, 25 bp, Rattus norvegicus
ttgtgacttcctcaacatcgaaccc

SEQ ID NO: 685262 - DNA, 25 bp, Rattus norvegicus
ttgtgacttcctgaacatcgaaccc

SEQ ID NO: 685263 - DNA, 25 bp, Rattus norvegicus
ttgtgacttgggattgctgatctcc

SEQ ID NO: 685264 - DNA, 25 bp, Rattus norvegicus
ttgtgacttgggtttgctgatctcc

SEQ ID NO: 685265 - DNA, 25 bp, Rattus norvegicus
ttgtgacttgttagcacttgtgcct

SEQ ID NO: 685266 - DNA, 25 bp, Rattus norvegicus
ttgtgacttgtttgcacttgtgcct

SEQ ID NO: 685267 - DNA, 25 bp, Rattus norvegicus
ttgtgactttgtatcccatggtact

SEQ ID NO: 685268 - DNA, 25 bp, Rattus norvegicus
ttgtgactttgtttcccatggtact

SEQ ID NO: 685269 - DNA, 25 bp, Rattus norvegicus
ttgtgacttttgactgcagtggaat

SEQ ID NO: 685270 - DNA, 25 bp, Rattus norvegicus
ttgtgacttttgtctgcagtggaat

SEQ ID NO: 685271 - DNA, 25 bp, Rattus norvegicus
ttgtgagaacccctctttgccttcc

SEQ ID NO: 685272 - DNA, 25 bp, Rattus norvegicus
ttgtgagaacccgtctttgccttcc

SEQ ID NO: 685273 - DNA, 25 bp, Rattus norvegicus
ttgtgagagaaacccagcccaggcc

SEQ ID NO: 685274 - DNA, 25 bp, Rattus norvegicus
ttgtgagagaaagccagcccaggcc

SEQ ID NO: 685275 - DNA, 25 bp, Rattus norvegicus
ttgtgagcacagaagctcccctgag

SEQ ID NO: 685276 - DNA, 25 bp, Rattus norvegicus
ttgtgagcacagtagctcccctgag

SEQ ID NO: 685277 - DNA, 25 bp, Rattus norvegicus
ttgtgagcagtgagggacttctcct

SEQ ID NO: 685278 - DNA, 25 bp, Rattus norvegicus
ttgtgagcagtgtgggacttctcct

SEQ ID NO: 685279 - DNA, 25 bp, Rattus norvegicus
ttgtgagccaagacttagccgtgtg

SEQ ID NO: 685280 - DNA, 25 bp, Rattus norvegicus
ttgtgagccaagtcttagccgtgtg

SEQ ID NO: 685281 - DNA, 25 bp, Rattus norvegicus
ttgtgagccaccaacagttcagagt

SEQ ID NO: 685282 - DNA, 25 bp, Rattus norvegicus
ttgtgagccacctacagttcagagt

SEQ ID NO: 685283 - DNA, 25 bp, Rattus norvegicus
ttgtgagccaggatggtttctcttg

SEQ ID NO: 685284 - DNA, 25 bp, Rattus norvegicus
ttgtgagccaggttggtttctcttg

SEQ ID NO: 685285 - DNA, 25 bp, Rattus norvegicus
ttgtgagcccgcaggtgagcatgac

SEQ ID NO: 685286 - DNA, 25 bp, Rattus norvegicus
ttgtgagcccgctggtgagcatgac

SEQ ID NO: 685287 - DNA, 25 bp, Rattus norvegicus
ttgtgagccgccctgtagattttaa

SEQ ID NO: 685288 - DNA, 25 bp, Rattus norvegicus
ttgtgagccgccgtgtagattttaa

SEQ ID NO: 685289 - DNA, 25 bp, Rattus norvegicus
ttgtgagcctatcgcctttagctgg

SEQ ID NO: 685290 - DNA, 25 bp, Rattus norvegicus
ttgtgagcctatggcctttagctgg

SEQ ID NO: 685291 - DNA, 25 bp, Rattus norvegicus
ttgtgagcctgtcaccatgtggcca

SEQ ID NO: 685292 - DNA, 25 bp, Rattus norvegicus
ttgtgagcctgtgaccatgtggcca

SEQ ID NO: 685293 - DNA, 25 bp, Rattus norvegicus
ttgtgagcctttctggatcacctcg

SEQ ID NO: 685294 - DNA, 25 bp, Rattus norvegicus
ttgtgagcctttgtggatcacctcg

SEQ ID NO: 685295 - DNA, 25 bp, Rattus norvegicus
ttgtgagctagtatctctcgcagct

SEQ ID NO: 685296 - DNA, 25 bp, Rattus norvegicus
ttgtgagctagtttctctcgcagct

SEQ ID NO: 685297 - DNA, 25 bp, Rattus norvegicus
ttgtgagctcatcgctccgggcaaa

SEQ ID NO: 685298 - DNA, 25 bp, Rattus norvegicus
ttgtgagctcatggctccgggcaaa

SEQ ID NO: 685299 - DNA, 25 bp, Rattus norvegicus
ttgtgagctctgactcagaactctt

SEQ ID NO: 685300 - DNA, 25 bp, Rattus norvegicus
ttgtgagctctgtctcagaactctt

SEQ ID NO: 685301 - DNA, 25 bp, Rattus norvegicus
ttgtgagctgccacgcgcttgctgc

SEQ ID NO: 685302 - DNA, 25 bp, Rattus norvegicus
ttgtgagctgcctcgcgcttgctgc

SEQ ID NO: 685303 - DNA, 25 bp, Rattus norvegicus
ttgtgaggaccaaactgtcaacccc

SEQ ID NO: 685304 - DNA, 25 bp, Rattus norvegicus
ttgtgaggaccatactgtcaacccc

SEQ ID NO: 685305 - DNA, 25 bp, Rattus norvegicus
ttgtgaggacctccacatcataggt

SEQ ID NO: 685306 - DNA, 25 bp, Rattus norvegicus
ttgtgaggacctgcacatcataggt

SEQ ID NO: 685307 - DNA, 25 bp, Rattus norvegicus
ttgtgaggatttccccatcccaggc

SEQ ID NO: 685308 - DNA, 25 bp, Rattus norvegicus
ttgtgaggatttgcccatcccaggc

SEQ ID NO: 685309 - DNA, 25 bp, Rattus norvegicus
ttgtgaggcatgctctgatgtctgt

SEQ ID NO: 685310 - DNA, 25 bp, Rattus norvegicus
ttgtgaggcatggtctgatgtctgt

SEQ ID NO: 685311 - DNA, 25 bp, Rattus norvegicus
ttgtgaggccacaggcatggatgct

SEQ ID NO: 685312 - DNA, 25 bp, Rattus norvegicus
ttgtgaggccactggcatggatgct

SEQ ID NO: 685313 - DNA, 25 bp, Rattus norvegicus
ttgtgaggcccaaggacaaggcact

SEQ ID NO: 685314 - DNA, 25 bp, Rattus norvegicus
ttgtgaggcccatggacaaggcact

SEQ ID NO: 685315 - DNA, 25 bp, Rattus norvegicus
ttgtgaggcttcagtacccggtgaa

SEQ ID NO: 685316 - DNA, 25 bp, Rattus norvegicus
ttgtgaggcttctgtacccggtgaa

SEQ ID NO: 685317 - DNA, 25 bp, Rattus norvegicus
ttgtgagggtctctggagtcactcc

SEQ ID NO: 685318 - DNA, 25 bp, Rattus norvegicus
ttgtgagggtctgtggagtcactcc

SEQ ID NO: 685319 - DNA, 25 bp, Rattus norvegicus
ttgtgaggtccccacggaagttact

SEQ ID NO: 685320 - DNA, 25 bp, Rattus norvegicus
ttgtgaggtcccgacggaagttact

SEQ ID NO: 685321 - DNA, 25 bp, Rattus norvegicus
ttgtgaggttctacttcaccctcct

SEQ ID NO: 685322 - DNA, 25 bp, Rattus norvegicus
ttgtgaggttcttcttcaccctcct

SEQ ID NO: 685323 - DNA, 25 bp, Rattus norvegicus
ttgtgagtaccaatgctctgggact

SEQ ID NO: 685324 - DNA, 25 bp, Rattus norvegicus
ttgtgagtaccattgctctgggact

SEQ ID NO: 685325 - DNA, 25 bp, Rattus norvegicus
ttgtgagtaggcacatttggcccac

SEQ ID NO: 685326 - DNA, 25 bp, Rattus norvegicus
ttgtgagtaggctcatttggcccac

SEQ ID NO: 685327 - DNA, 25 bp, Rattus norvegicus
ttgtgagtcaccataggcgcaataa

SEQ ID NO: 685328 - DNA, 25 bp, Rattus norvegicus
ttgtgagtcaccttaggcgcaataa

SEQ ID NO: 685329 - DNA, 25 bp, Rattus norvegicus
ttgtgagtcaggctctttctatgta

SEQ ID NO: 685330 - DNA, 25 bp, Rattus norvegicus
ttgtgagtcagggtctttctatgta

SEQ ID NO: 685331 - DNA, 25 bp, Rattus norvegicus
ttgtgagtgaccagggaaaccttga

SEQ ID NO: 685332 - DNA, 25 bp, Rattus norvegicus
ttgtgagtgacctgggaaaccttga

SEQ ID NO: 685333 - DNA, 25 bp, Rattus norvegicus
ttgtgagtgcacacacgtgccatga

SEQ ID NO: 685334 - DNA, 25 bp, Rattus norvegicus
ttgtgagtgcactcacgtgccatga

SEQ ID NO: 685335 - DNA, 25 bp, Rattus norvegicus
ttgtgagtgccccaatgaacgccaa

SEQ ID NO: 685336 - DNA, 25 bp, Rattus norvegicus
ttgtgagtgcccgaatgaacgccaa

SEQ ID NO: 685337 - DNA, 25 bp, Rattus norvegicus
ttgtgagttacacctgagccctctg

SEQ ID NO: 685338 - DNA, 25 bp, Rattus norvegicus
ttgtgagttacagctgagccctctg

SEQ ID NO: 685339 - DNA, 25 bp, Rattus norvegicus
ttgtgagttataacagcgcctggat

SEQ ID NO: 685340 - DNA, 25 bp, Rattus norvegicus
ttgtgagttatatcagcgcctggat

SEQ ID NO: 685341 - DNA, 25 bp, Rattus norvegicus
ttgtgagtttctacagctgggtgcc

SEQ ID NO: 685342 - DNA, 25 bp, Rattus norvegicus
ttgtgagtttctatccccattgttt

SEQ ID NO: 685343 - DNA, 25 bp, Rattus norvegicus
ttgtgagtttcttcagctgggtgcc

SEQ ID NO: 685344 - DNA, 25 bp, Rattus norvegicus
ttgtgagtttctttccccattgttt

SEQ ID NO: 685345 - DNA, 25 bp, Rattus norvegicus
ttgtgatactacacggaccttcctt

SEQ ID NO: 685346 - DNA, 25 bp, Rattus norvegicus
ttgtgatactactcggaccttcctt

SEQ ID NO: 685347 - DNA, 25 bp, Rattus norvegicus
ttgtgatcacatccagtctcagcta

SEQ ID NO: 685348 - DNA, 25 bp, Rattus norvegicus
ttgtgatcacatgcagtctcagcta

SEQ ID NO: 685349 - DNA, 25 bp, Rattus norvegicus
ttgtgatccaaacctgcatgactct

SEQ ID NO: 685350 - DNA, 25 bp, Rattus norvegicus
ttgtgatccaaagctgcatgactct

SEQ ID NO: 685351 - DNA, 25 bp, Rattus norvegicus
ttgtgatctcacagtcattgacttg

SEQ ID NO: 685352 - DNA, 25 bp, Rattus norvegicus
ttgtgatctcactgtcattgacttg

SEQ ID NO: 685353 - DNA, 25 bp, Rattus norvegicus
ttgtgatctggacgcattcttttgg

SEQ ID NO: 685354 - DNA, 25 bp, Rattus norvegicus
ttgtgatctggaggcattcttttgg

SEQ ID NO: 685355 - DNA, 25 bp, Rattus norvegicus
ttgtgatctttaattctccagcccg

SEQ ID NO: 685356 - DNA, 25 bp, Rattus norvegicus
ttgtgatctttatttctccagcccg

SEQ ID NO: 685357 - DNA, 25 bp, Rattus norvegicus
ttgtgatgaaaacaacactcgtgga

SEQ ID NO: 685358 - DNA, 25 bp, Rattus norvegicus
ttgtgatgaaaagaacactcgtgga

SEQ ID NO: 685359 - DNA, 25 bp, Rattus norvegicus
ttgtgatgagagaatatgaagcccc

SEQ ID NO: 685360 - DNA, 25 bp, Rattus norvegicus
ttgtgatgagagtatatgaagcccc

SEQ ID NO: 685361 - DNA, 25 bp, Rattus norvegicus
ttgtgatgagctaagtccatcttta

SEQ ID NO: 685362 - DNA, 25 bp, Rattus norvegicus
ttgtgatgagcttagtccatcttta

SEQ ID NO: 685363 - DNA, 25 bp, Rattus norvegicus
ttgtgatgccaaagccggtgtttta

SEQ ID NO: 685364 - DNA, 25 bp, Rattus norvegicus
ttgtgatgccaatgccggtgtttta

SEQ ID NO: 685365 - DNA, 25 bp, Rattus norvegicus
ttgtgatgccctacaacatggacac

SEQ ID NO: 685366 - DNA, 25 bp, Rattus norvegicus
ttgtgatgcccttcaacatggacac

SEQ ID NO: 685367 - DNA, 25 bp, Rattus norvegicus
ttgtgatggaagcaagatccaggct

SEQ ID NO: 685368 - DNA, 25 bp, Rattus norvegicus
ttgtgatggaaggaagatccaggct

SEQ ID NO: 685369 - DNA, 25 bp, Rattus norvegicus
ttgtgatggtgcaccacctagccat

SEQ ID NO: 685370 - DNA, 25 bp, Rattus norvegicus
ttgtgatggtgctccacctagccat

SEQ ID NO: 685371 - DNA, 25 bp, Rattus norvegicus
ttgtgatgtcatcgcttgtctaaat

SEQ ID NO: 685372 - DNA, 25 bp, Rattus norvegicus
ttgtgatgtcatggcttgtctaaat

SEQ ID NO: 685373 - DNA, 25 bp, Rattus norvegicus
ttgtgattacagactcagcttacct

SEQ ID NO: 685374 - DNA, 25 bp, Rattus norvegicus
ttgtgattacagtctcagcttacct

SEQ ID NO: 685375 - DNA, 25 bp, Rattus norvegicus
ttgtgattcaagaccttgtccccag

SEQ ID NO: 685376 - DNA, 25 bp, Rattus norvegicus
ttgtgattcaagtccttgtccccag

SEQ ID NO: 685377 - DNA, 25 bp, Rattus norvegicus
ttgtgattccaaagaccagtgtctc

SEQ ID NO: 685378 - DNA, 25 bp, Rattus norvegicus
ttgtgattccaatgaccagtgtctc

SEQ ID NO: 685379 - DNA, 25 bp, Rattus norvegicus
ttgtgattcgccatggcagttactc

SEQ ID NO: 685380 - DNA, 25 bp, Rattus norvegicus
ttgtgattcgccttggcagttactc

SEQ ID NO: 685381 - DNA, 25 bp, Rattus norvegicus
ttgtgattctcaagctacctgaggg

SEQ ID NO: 685382 - DNA, 25 bp, Rattus norvegicus
ttgtgattctcacttctggtttctg

SEQ ID NO: 685383 - DNA, 25 bp, Rattus norvegicus
ttgtgattctcagttctggtttctg

SEQ ID NO: 685384 - DNA, 25 bp, Rattus norvegicus
ttgtgattctcatgctacctgaggg

SEQ ID NO: 685385 - DNA, 25 bp, Rattus norvegicus
ttgtgattctgtctttcacccttgt

SEQ ID NO: 685386 - DNA, 25 bp, Rattus norvegicus
ttgtgattctgtgtttcacccttgt

SEQ ID NO: 685387 - DNA, 25 bp, Rattus norvegicus
ttgtgattgccaccttatatcccca

SEQ ID NO: 685388 - DNA, 25 bp, Rattus norvegicus
ttgtgattgccagcttatatcccca

SEQ ID NO: 685389 - DNA, 25 bp, Rattus norvegicus
ttgtgatttggtcgcaattactcat

SEQ ID NO: 685390 - DNA, 25 bp, Rattus norvegicus
ttgtgatttggtggcaattactcat

SEQ ID NO: 685391 - DNA, 25 bp, Rattus norvegicus
ttgtgatttgtgacctgtcctctgg

SEQ ID NO: 685392 - DNA, 25 bp, Rattus norvegicus
ttgtgatttgtgtcctgtcctctgg

SEQ ID NO: 685393 - DNA, 25 bp, Rattus norvegicus
ttgtgattttcaccatctgctttgc

SEQ ID NO: 685394 - DNA, 25 bp, Rattus norvegicus
ttgtgattttcagcatctgctttgc

SEQ ID NO: 685395 - DNA, 25 bp, Rattus norvegicus
ttgtgcaaagttactccaacagact

SEQ ID NO: 685396 - DNA, 25 bp, Rattus norvegicus
ttgtgcaaagtttctccaacagact

SEQ ID NO: 685397 - DNA, 25 bp, Rattus norvegicus
ttgtgcaaccacaacaggtgaacat

SEQ ID NO: 685398 - DNA, 25 bp, Rattus norvegicus
ttgtgcaaccactacaggtgaacat

SEQ ID NO: 685399 - DNA, 25 bp, Rattus norvegicus
ttgtgcaagctcactacttcagatg

SEQ ID NO: 685400 - DNA, 25 bp, Rattus norvegicus
ttgtgcaagctctctacttcagatg

SEQ ID NO: 685401 - DNA, 25 bp, Rattus norvegicus
ttgtgcaaggcaaccatgagctgta

SEQ ID NO: 685402 - DNA, 25 bp, Rattus norvegicus
ttgtgcaaggcatccatgagctgta

SEQ ID NO: 685403 - DNA, 25 bp, Rattus norvegicus
ttgtgcaaggtcaattcactttgta

SEQ ID NO: 685404 - DNA, 25 bp, Rattus norvegicus
ttgtgcaaggtctattcactttgta

SEQ ID NO: 685405 - DNA, 25 bp, Rattus norvegicus
ttgtgcaagtacacccttcagtctg

SEQ ID NO: 685406 - DNA, 25 bp, Rattus norvegicus
ttgtgcaagtactcccttcagtctg

SEQ ID NO: 685407 - DNA, 25 bp, Rattus norvegicus
ttgtgcaatcgtatcctttttaatt

SEQ ID NO: 685408 - DNA, 25 bp, Rattus norvegicus
ttgtgcaatcgtttcctttttaatt

SEQ ID NO: 685409 - DNA, 25 bp, Rattus norvegicus
ttgtgcaatggcattctcttcagaa

SEQ ID NO: 685410 - DNA, 25 bp, Rattus norvegicus
ttgtgcaatggctttctcttcagaa

SEQ ID NO: 685411 - DNA, 25 bp, Rattus norvegicus
ttgtgcacacatccatgaaccagtc

SEQ ID NO: 685412 - DNA, 25 bp, Rattus norvegicus
ttgtgcacacatgcatgaaccagtc

SEQ ID NO: 685413 - DNA, 25 bp, Rattus norvegicus
ttgtgcacatatatctgctaccacc

SEQ ID NO: 685414 - DNA, 25 bp, Rattus norvegicus
ttgtgcacatatttctgctaccacc

SEQ ID NO: 685415 - DNA, 25 bp, Rattus norvegicus
ttgtgcaccattaaacatcccacta

SEQ ID NO: 685416 - DNA, 25 bp, Rattus norvegicus
ttgtgcaccatttaacatcccacta

SEQ ID NO: 685417 - DNA, 25 bp, Rattus norvegicus
ttgtgcacgccgacctcagcgagta

SEQ ID NO: 685418 - DNA, 25 bp, Rattus norvegicus
ttgtgcacgccgtcctcagcgagta

SEQ ID NO: 685419 - DNA, 25 bp, Rattus norvegicus
ttgtgcactggcctgcataggatga

SEQ ID NO: 685420 - DNA, 25 bp, Rattus norvegicus
ttgtgcactggcgtgcataggatga

SEQ ID NO: 685421 - DNA, 25 bp, Rattus norvegicus
ttgtgcacttatcccctgaatggat

SEQ ID NO: 685422 - DNA, 25 bp, Rattus norvegicus
ttgtgcacttatgccctgaatggat

SEQ ID NO: 685423 - DNA, 25 bp, Rattus norvegicus
ttgtgcactttcctcatcaagaaga

SEQ ID NO: 685424 - DNA, 25 bp, Rattus norvegicus
ttgtgcactttcgtcatcaagaaga

SEQ ID NO: 685425 - DNA, 25 bp, Rattus norvegicus
ttgtgcagagcccaacacgagcttc

SEQ ID NO: 685426 - DNA, 25 bp, Rattus norvegicus
ttgtgcagagccgaacacgagcttc

SEQ ID NO: 685427 - DNA, 25 bp, Rattus norvegicus
ttgtgcagcacaatgacgcgctcac

SEQ ID NO: 685428 - DNA, 25 bp, Rattus norvegicus
ttgtgcagcacattgacgcgctcac

SEQ ID NO: 685429 - DNA, 25 bp, Rattus norvegicus
ttgtgcagcactcagccagcaggaa

SEQ ID NO: 685430 - DNA, 25 bp, Rattus norvegicus
ttgtgcagcactgagccagcaggaa

SEQ ID NO: 685431 - DNA, 25 bp, Rattus norvegicus
ttgtgcagccaactcagactccaag

SEQ ID NO: 685432 - DNA, 25 bp, Rattus norvegicus
ttgtgcagccaagtcagactccaag

SEQ ID NO: 685433 - DNA, 25 bp, Rattus norvegicus
ttgtgcagcgtgactttgtgatact

SEQ ID NO: 685434 - DNA, 25 bp, Rattus norvegicus
ttgtgcagcgtgtctttgtgatact

SEQ ID NO: 685435 - DNA, 25 bp, Rattus norvegicus
ttgtgcagctcgaagtcggcgtcga

SEQ ID NO: 685436 - DNA, 25 bp, Rattus norvegicus
ttgtgcagctcgtagtcggcgtcga

SEQ ID NO: 685437 - DNA, 25 bp, Rattus norvegicus
ttgtgcagggcaattacacgccatc

SEQ ID NO: 685438 - DNA, 25 bp, Rattus norvegicus
ttgtgcagggcatttacacgccatc

SEQ ID NO: 685439 - DNA, 25 bp, Rattus norvegicus
ttgtgcagggccacatggtctcagg

SEQ ID NO: 685440 - DNA, 25 bp, Rattus norvegicus
ttgtgcagggcctcatggtctcagg

SEQ ID NO: 685441 - DNA, 25 bp, Rattus norvegicus
ttgtgcagggtgagcagcctttcca

SEQ ID NO: 685442 - DNA, 25 bp, Rattus norvegicus
ttgtgcagggtgtgcagcctttcca

SEQ ID NO: 685443 - DNA, 25 bp, Rattus norvegicus
ttgtgcagtcatcccagtaccgtgc

SEQ ID NO: 685444 - DNA, 25 bp, Rattus norvegicus
ttgtgcagtcatgccagtaccgtgc

SEQ ID NO: 685445 - DNA, 25 bp, Rattus norvegicus
ttgtgcatattcagccctcaatgag

SEQ ID NO: 685446 - DNA, 25 bp, Rattus norvegicus
ttgtgcatattctgccctcaatgag

SEQ ID NO: 685447 - DNA, 25 bp, Rattus norvegicus
ttgtgcatccaccactgcatatgtg

SEQ ID NO: 685448 - DNA, 25 bp, Rattus norvegicus
ttgtgcatccacgactgcatatgtg

SEQ ID NO: 685449 - DNA, 25 bp, Rattus norvegicus
ttgtgcatgctcacttttggcaaca

SEQ ID NO: 685450 - DNA, 25 bp, Rattus norvegicus
ttgtgcatgctctcttttggcaaca

SEQ ID NO: 685451 - DNA, 25 bp, Rattus norvegicus
ttgtgcatgttacgccagcgtgcta

SEQ ID NO: 685452 - DNA, 25 bp, Rattus norvegicus
ttgtgcatgttaggccagcgtgcta

SEQ ID NO: 685453 - DNA, 25 bp, Rattus norvegicus
ttgtgcattctacgccctgtagatg

SEQ ID NO: 685454 - DNA, 25 bp, Rattus norvegicus
ttgtgcattctaggccctgtagatg

SEQ ID NO: 685455 - DNA, 25 bp, Rattus norvegicus
ttgtgcattgttcattgtcctctct

SEQ ID NO: 685456 - DNA, 25 bp, Rattus norvegicus
ttgtgcattgttgattgtcctctct

SEQ ID NO: 685457 - DNA, 25 bp, Rattus norvegicus
ttgtgccaacaaactgctggtccat

SEQ ID NO: 685458 - DNA, 25 bp, Rattus norvegicus
ttgtgccaacaatctgctggtccat

SEQ ID NO: 685459 - DNA, 25 bp, Rattus norvegicus
ttgtgccaagggaagtcatgactct

SEQ ID NO: 685460 - DNA, 25 bp, Rattus norvegicus
ttgtgccaagggtagtcatgactct

SEQ ID NO: 685461 - DNA, 25 bp, Rattus norvegicus
ttgtgccaatatctgcttgctcttc

SEQ ID NO: 685462 - DNA, 25 bp, Rattus norvegicus
ttgtgccaatatgtgcttgctcttc

SEQ ID NO: 685463 - DNA, 25 bp, Rattus norvegicus
ttgtgccagaatcccgaacagtctt

SEQ ID NO: 685464 - DNA, 25 bp, Rattus norvegicus
ttgtgccagaatgccgaacagtctt

SEQ ID NO: 685465 - DNA, 25 bp, Rattus norvegicus
ttgtgccagcacagtatgtttgcaa

SEQ ID NO: 685466 - DNA, 25 bp, Rattus norvegicus
ttgtgccagcactgtatgtttgcaa

SEQ ID NO: 685467 - DNA, 25 bp, Rattus norvegicus
ttgtgccatccaacattttgtatgt

SEQ ID NO: 685468 - DNA, 25 bp, Rattus norvegicus
ttgtgccatccatcattttgtatgt

SEQ ID NO: 685469 - DNA, 25 bp, Rattus norvegicus
ttgtgccatgacacttatctacagc

SEQ ID NO: 685470 - DNA, 25 bp, Rattus norvegicus
ttgtgccatgactcttatctacagc

SEQ ID NO: 685471 - DNA, 25 bp, Rattus norvegicus
ttgtgccatgtcacggccaaagtga

SEQ ID NO: 685472 - DNA, 25 bp, Rattus norvegicus
ttgtgccatgtctcggccaaagtga

SEQ ID NO: 685473 - DNA, 25 bp, Rattus norvegicus
ttgtgcccaagcaggtgccagtacc

SEQ ID NO: 685474 - DNA, 25 bp, Rattus norvegicus
ttgtgcccaagctggtgccagtacc

SEQ ID NO: 685475 - DNA, 25 bp, Rattus norvegicus
ttgtgcccaccacagtaacctctga

SEQ ID NO: 685476 - DNA, 25 bp, Rattus norvegicus
ttgtgcccaccagagtaacctctga

SEQ ID NO: 685477 - DNA, 25 bp, Rattus norvegicus
ttgtgcccactactttctcattttg

SEQ ID NO: 685478 - DNA, 25 bp, Rattus norvegicus
ttgtgcccactagtttctcattttg

SEQ ID NO: 685479 - DNA, 25 bp, Rattus norvegicus
ttgtgcccagcgagtggaccgacga

SEQ ID NO: 685480 - DNA, 25 bp, Rattus norvegicus
ttgtgcccagcgtgtggaccgacga

SEQ ID NO: 685481 - DNA, 25 bp, Rattus norvegicus
ttgtgcccagttaactatccagtat

SEQ ID NO: 685482 - DNA, 25 bp, Rattus norvegicus
ttgtgcccagtttactatccagtat

SEQ ID NO: 685483 - DNA, 25 bp, Rattus norvegicus
ttgtgccccaggctctgcattgtaa

SEQ ID NO: 685484 - DNA, 25 bp, Rattus norvegicus
ttgtgccccagggtctgcattgtaa

SEQ ID NO: 685485 - DNA, 25 bp, Rattus norvegicus
ttgtgcccctatattacagatcggt

SEQ ID NO: 685486 - DNA, 25 bp, Rattus norvegicus
ttgtgcccctattttacagatcggt

SEQ ID NO: 685487 - DNA, 25 bp, Rattus norvegicus
ttgtgccccttacctagtgtaaaat

SEQ ID NO: 685488 - DNA, 25 bp, Rattus norvegicus
ttgtgccccttagctagtgtaaaat

SEQ ID NO: 685489 - DNA, 25 bp, Rattus norvegicus
ttgtgcccgctgcttgtactttcca

SEQ ID NO: 685490 - DNA, 25 bp, Rattus norvegicus
ttgtgcccgctggttgtactttcca

SEQ ID NO: 685491 - DNA, 25 bp, Rattus norvegicus
ttgtgccctaagctgggttggttca

SEQ ID NO: 685492 - DNA, 25 bp, Rattus norvegicus
ttgtgccctaaggtgggttggttca

SEQ ID NO: 685493 - DNA, 25 bp, Rattus norvegicus
ttgtgccctccgactatgagtgtgc

SEQ ID NO: 685494 - DNA, 25 bp, Rattus norvegicus
ttgtgccctccgtctatgagtgtgc

SEQ ID NO: 685495 - DNA, 25 bp, Rattus norvegicus
ttgtgccctggtattcttatcatat

SEQ ID NO: 685496 - DNA, 25 bp, Rattus norvegicus
ttgtgccctggttttcttatcatat

SEQ ID NO: 685497 - DNA, 25 bp, Rattus norvegicus
ttgtgccctgtcaaactgtgtttgt

SEQ ID NO: 685498 - DNA, 25 bp, Rattus norvegicus
ttgtgccctgtctaactgtgtttgt

SEQ ID NO: 685499 - DNA, 25 bp, Rattus norvegicus
ttgtgccctgtgattgatggagtag

SEQ ID NO: 685500 - DNA, 25 bp, Rattus norvegicus
ttgtgccctgtgtttgatggagtag

SEQ ID NO: 685501 - DNA, 25 bp, Rattus norvegicus
ttgtgcctacaaacacttagtaaat

SEQ ID NO: 685502 - DNA, 25 bp, Rattus norvegicus
ttgtgcctacaatcacttagtaaat

SEQ ID NO: 685503 - DNA, 25 bp, Rattus norvegicus
ttgtgcctcaccctaactgaagctc

SEQ ID NO: 685504 - DNA, 25 bp, Rattus norvegicus
ttgtgcctcaccgtaactgaagctc

SEQ ID NO: 685505 - DNA, 25 bp, Rattus norvegicus
ttgtgcctcacgactgttgttttcc

SEQ ID NO: 685506 - DNA, 25 bp, Rattus norvegicus
ttgtgcctcacgtctgttgttttcc

SEQ ID NO: 685507 - DNA, 25 bp, Rattus norvegicus
ttgtgcctcattcctgattgccaaa

SEQ ID NO: 685508 - DNA, 25 bp, Rattus norvegicus
ttgtgcctcattgctgattgccaaa

SEQ ID NO: 685509 - DNA, 25 bp, Rattus norvegicus
ttgtgcctccaaagccatgcagaga

SEQ ID NO: 685510 - DNA, 25 bp, Rattus norvegicus
ttgtgcctccaatgccatgcagaga

SEQ ID NO: 685511 - DNA, 25 bp, Rattus norvegicus
ttgtgcctccctatcatagaagtag

SEQ ID NO: 685512 - DNA, 25 bp, Rattus norvegicus
ttgtgcctccctttcatagaagtag

SEQ ID NO: 685513 - DNA, 25 bp, Rattus norvegicus
ttgtgcctcctaatgaaacccagac

SEQ ID NO: 685514 - DNA, 25 bp, Rattus norvegicus
ttgtgcctcctattgaaacccagac

SEQ ID NO: 685515 - DNA, 25 bp, Rattus norvegicus
ttgtgcctcggcacacgtggtcgga

SEQ ID NO: 685516 - DNA, 25 bp, Rattus norvegicus
ttgtgcctcggctcacgtggtcgga

SEQ ID NO: 685517 - DNA, 25 bp, Rattus norvegicus
ttgtgcctcttccttacattttgtc

SEQ ID NO: 685518 - DNA, 25 bp, Rattus norvegicus
ttgtgcctcttcgttacattttgtc

SEQ ID NO: 685519 - DNA, 25 bp, Rattus norvegicus
ttgtgcctctttccccaaaggatat

SEQ ID NO: 685520 - DNA, 25 bp, Rattus norvegicus
ttgtgcctctttgcccaaaggatat

SEQ ID NO: 685521 - DNA, 25 bp, Rattus norvegicus
ttgtgcctgagcatcctcacactca

SEQ ID NO: 685522 - DNA, 25 bp, Rattus norvegicus
ttgtgcctgagcttcctcacactca

SEQ ID NO: 685523 - DNA, 25 bp, Rattus norvegicus
ttgtgcctgagtacgcttgtccaac

SEQ ID NO: 685524 - DNA, 25 bp, Rattus norvegicus
ttgtgcctgagttcgcttgtccaac

SEQ ID NO: 685525 - DNA, 25 bp, Rattus norvegicus
ttgtgcctgcaaataaagctactgg

SEQ ID NO: 685526 - DNA, 25 bp, Rattus norvegicus
ttgtgcctgcaattaaagctactgg

SEQ ID NO: 685527 - DNA, 25 bp, Rattus norvegicus
ttgtgcctgcacagagggtcttgat

SEQ ID NO: 685528 - DNA, 25 bp, Rattus norvegicus
ttgtgcctgcactgagggtcttgat

SEQ ID NO: 685529 - DNA, 25 bp, Rattus norvegicus
ttgtgcctggctcatcctgggaaat

SEQ ID NO: 685530 - DNA, 25 bp, Rattus norvegicus
ttgtgcctggctcatggtagagcac

SEQ ID NO: 685531 - DNA, 25 bp, Rattus norvegicus
ttgtgcctggctgatcctgggaaat

SEQ ID NO: 685532 - DNA, 25 bp, Rattus norvegicus
ttgtgcctggctgatggtagagcac

SEQ ID NO: 685533 - DNA, 25 bp, Rattus norvegicus
ttgtgcctgtttccagcttagttct

SEQ ID NO: 685534 - DNA, 25 bp, Rattus norvegicus
ttgtgcctgtttgcagcttagttct

SEQ ID NO: 685535 - DNA, 25 bp, Rattus norvegicus
ttgtgccttcagaccggttgttttc

SEQ ID NO: 685536 - DNA, 25 bp, Rattus norvegicus
ttgtgccttcagtccggttgttttc

SEQ ID NO: 685537 - DNA, 25 bp, Rattus norvegicus
ttgtgccttcttccagaatgtttta

SEQ ID NO: 685538 - DNA, 25 bp, Rattus norvegicus
ttgtgccttcttgcagaatgtttta

SEQ ID NO: 685539 - DNA, 25 bp, Rattus norvegicus
ttgtgccttgtcatcatcaccttag

SEQ ID NO: 685540 - DNA, 25 bp, Rattus norvegicus
ttgtgccttgtcttcatcaccttag

SEQ ID NO: 685541 - DNA, 25 bp, Rattus norvegicus
ttgtgcctttcgacgacaccctgat

SEQ ID NO: 685542 - DNA, 25 bp, Rattus norvegicus
ttgtgcctttcgtcgacaccctgat

SEQ ID NO: 685543 - DNA, 25 bp, Rattus norvegicus
ttgtgccttttaactgcctggacat

SEQ ID NO: 685544 - DNA, 25 bp, Rattus norvegicus
ttgtgccttttatctgcctggacat

SEQ ID NO: 685545 - DNA, 25 bp, Rattus norvegicus
ttgtgcgacagcaagatccggtcca

SEQ ID NO: 685546 - DNA, 25 bp, Rattus norvegicus
ttgtgcgacagctagatccggtcca

SEQ ID NO: 685547 - DNA, 25 bp, Rattus norvegicus
ttgtgcgagcaacagagggatctct

SEQ ID NO: 685548 - DNA, 25 bp, Rattus norvegicus
ttgtgcgagcaagagagggatctct

SEQ ID NO: 685549 - DNA, 25 bp, Rattus norvegicus
ttgtgcgcaagcacatggatctgtg

SEQ ID NO: 685550 - DNA, 25 bp, Rattus norvegicus
ttgtgcgcaagctcatggatctgtg

SEQ ID NO: 685551 - DNA, 25 bp, Rattus norvegicus
ttgtgcggacgtcacacagtgagca

SEQ ID NO: 685552 - DNA, 25 bp, Rattus norvegicus
ttgtgcggacgtgacacagtgagca

SEQ ID NO: 685553 - DNA, 25 bp, Rattus norvegicus
ttgtgcgtccttcagttgacctaaa

SEQ ID NO: 685554 - DNA, 25 bp, Rattus norvegicus
ttgtgcgtccttgagttgacctaaa

SEQ ID NO: 685555 - DNA, 25 bp, Rattus norvegicus
ttgtgcgtcgtaacctattttgtga

SEQ ID NO: 685556 - DNA, 25 bp, Rattus norvegicus
ttgtgcgtcgtatcctattttgtga

SEQ ID NO: 685557 - DNA, 25 bp, Rattus norvegicus
ttgtgcgtgcacaaggcaaatatag

SEQ ID NO: 685558 - DNA, 25 bp, Rattus norvegicus
ttgtgcgtgcactaggcaaatatag

SEQ ID NO: 685559 - DNA, 25 bp, Rattus norvegicus
ttgtgcgttcacctagaagccttac

SEQ ID NO: 685560 - DNA, 25 bp, Rattus norvegicus
ttgtgcgttcacgtagaagccttac

SEQ ID NO: 685561 - DNA, 25 bp, Rattus norvegicus
ttgtgcgttggtctcctgcataaac

SEQ ID NO: 685562 - DNA, 25 bp, Rattus norvegicus
ttgtgcgttggtgtcctgcataaac

SEQ ID NO: 685563 - DNA, 25 bp, Rattus norvegicus
ttgtgcgttttgatgattcttatcc

SEQ ID NO: 685564 - DNA, 25 bp, Rattus norvegicus
ttgtgcgttttgttgattcttatcc

SEQ ID NO: 685565 - DNA, 25 bp, Rattus norvegicus
ttgtgctaaataaccctgaactttg

SEQ ID NO: 685566 - DNA, 25 bp, Rattus norvegicus
ttgtgctaaatatccctgaactttg

SEQ ID NO: 685567 - DNA, 25 bp, Rattus norvegicus
ttgtgctaacacatttgctcttggt

SEQ ID NO: 685568 - DNA, 25 bp, Rattus norvegicus
ttgtgctaacacttttgctcttggt

SEQ ID NO: 685569 - DNA, 25 bp, Rattus norvegicus
ttgtgctactgtacttcggtgctgg

SEQ ID NO: 685570 - DNA, 25 bp, Rattus norvegicus
ttgtgctactgttcttcggtgctgg

SEQ ID NO: 685571 - DNA, 25 bp, Rattus norvegicus
ttgtgctacttgatcagttcctgcc

SEQ ID NO: 685572 - DNA, 25 bp, Rattus norvegicus
ttgtgctacttgttcagttcctgcc

SEQ ID NO: 685573 - DNA, 25 bp, Rattus norvegicus
ttgtgctatctcagtgacctggaat

SEQ ID NO: 685574 - DNA, 25 bp, Rattus norvegicus
ttgtgctatctctgtgacctggaat

SEQ ID NO: 685575 - DNA, 25 bp, Rattus norvegicus
ttgtgctcaagtagccctgctggca

SEQ ID NO: 685576 - DNA, 25 bp, Rattus norvegicus
ttgtgctcaagttgccctgctggca

SEQ ID NO: 685577 - DNA, 25 bp, Rattus norvegicus
ttgtgctcatctcaggtgtggctca

SEQ ID NO: 685578 - DNA, 25 bp, Rattus norvegicus
ttgtgctcatctgaggtgtggctca

SEQ ID NO: 685579 - DNA, 25 bp, Rattus norvegicus
ttgtgctccgtgctgagtgctgtct

SEQ ID NO: 685580 - DNA, 25 bp, Rattus norvegicus
ttgtgctccgtggtgagtgctgtct

SEQ ID NO: 685581 - DNA, 25 bp, Rattus norvegicus
ttgtgctcgctgatcgggcgtgctc

SEQ ID NO: 685582 - DNA, 25 bp, Rattus norvegicus
ttgtgctcgctgttcgggcgtgctc

SEQ ID NO: 685583 - DNA, 25 bp, Rattus norvegicus
ttgtgctctattatccccaagtaaa

SEQ ID NO: 685584 - DNA, 25 bp, Rattus norvegicus
ttgtgctctattttccccaagtaaa

SEQ ID NO: 685585 - DNA, 25 bp, Rattus norvegicus
ttgtgctctgcaagaaccatgtccg

SEQ ID NO: 685586 - DNA, 25 bp, Rattus norvegicus
ttgtgctctgcatgaaccatgtccg

SEQ ID NO: 685587 - DNA, 25 bp, Rattus norvegicus
ttgtgctctgtacatttgttttcaa

SEQ ID NO: 685588 - DNA, 25 bp, Rattus norvegicus
ttgtgctctgtagatttgttttcaa

SEQ ID NO: 685589 - DNA, 25 bp, Rattus norvegicus
ttgtgctctgtcattggcttttaaa

SEQ ID NO: 685590 - DNA, 25 bp, Rattus norvegicus
ttgtgctctgtctttggcttttaaa

SEQ ID NO: 685591 - DNA, 25 bp, Rattus norvegicus
ttgtgctgactgctcagggactcag

SEQ ID NO: 685592 - DNA, 25 bp, Rattus norvegicus
ttgtgctgactggtcagggactcag

SEQ ID NO: 685593 - DNA, 25 bp, Rattus norvegicus
ttgtgctgagacacctggtgtttga

SEQ ID NO: 685594 - DNA, 25 bp, Rattus norvegicus
ttgtgctgagactcctggtgtttga

SEQ ID NO: 685595 - DNA, 25 bp, Rattus norvegicus
ttgtgctgaggtaatggcctcccac

SEQ ID NO: 685596 - DNA, 25 bp, Rattus norvegicus
ttgtgctgaggttatggcctcccac

SEQ ID NO: 685597 - DNA, 25 bp, Rattus norvegicus
ttgtgctgcacaaaactgcttggaa

SEQ ID NO: 685598 - DNA, 25 bp, Rattus norvegicus
ttgtgctgcacataactgcttggaa

SEQ ID NO: 685599 - DNA, 25 bp, Rattus norvegicus
ttgtgctgcagcaggccgagaaaaa

SEQ ID NO: 685600 - DNA, 25 bp, Rattus norvegicus
ttgtgctgcagctggccgagaaaaa

SEQ ID NO: 685601 - DNA, 25 bp, Rattus norvegicus
ttgtgctgcctgaccccagaagctg

SEQ ID NO: 685602 - DNA, 25 bp, Rattus norvegicus
ttgtgctgcctgagactgtgttaaa

SEQ ID NO: 685603 - DNA, 25 bp, Rattus norvegicus
ttgtgctgcctgtccccagaagctg

SEQ ID NO: 685604 - DNA, 25 bp, Rattus norvegicus
ttgtgctgcctgtgactgtgttaaa

SEQ ID NO: 685605 - DNA, 25 bp, Rattus norvegicus
ttgtgctgcgcactaaggtctacct

SEQ ID NO: 685606 - DNA, 25 bp, Rattus norvegicus
ttgtgctgcgcagtaaggtctacct

SEQ ID NO: 685607 - DNA, 25 bp, Rattus norvegicus
ttgtgctggctactcttagtcaact

SEQ ID NO: 685608 - DNA, 25 bp, Rattus norvegicus
ttgtgctggctagtcttagtcaact

SEQ ID NO: 685609 - DNA, 25 bp, Rattus norvegicus
ttgtgctgtgtacatcactgcttta

SEQ ID NO: 685610 - DNA, 25 bp, Rattus norvegicus
ttgtgctgtgtagatcactgcttta

SEQ ID NO: 685611 - DNA, 25 bp, Rattus norvegicus
ttgtgctgtgtcagtaatgcctgag

SEQ ID NO: 685612 - DNA, 25 bp, Rattus norvegicus
ttgtgctgtgtctgtaatgcctgag

SEQ ID NO: 685613 - DNA, 25 bp, Rattus norvegicus
ttgtgcttacatctacttctggcgt

SEQ ID NO: 685614 - DNA, 25 bp, Rattus norvegicus
ttgtgcttacatgtacttctggcgt

SEQ ID NO: 685615 - DNA, 25 bp, Rattus norvegicus
ttgtgcttatttatggagactgcct

SEQ ID NO: 685616 - DNA, 25 bp, Rattus norvegicus
ttgtgcttatttttggagactgcct

SEQ ID NO: 685617 - DNA, 25 bp, Rattus norvegicus
ttgtgcttcactcggttttggacga

SEQ ID NO: 685618 - DNA, 25 bp, Rattus norvegicus
ttgtgcttcactgggttttggacga

SEQ ID NO: 685619 - DNA, 25 bp, Rattus norvegicus
ttgtgcttcagacatactttctttc

SEQ ID NO: 685620 - DNA, 25 bp, Rattus norvegicus
ttgtgcttcagagatactttctttc

SEQ ID NO: 685621 - DNA, 25 bp, Rattus norvegicus
ttgtgcttcccgattcctggacact

SEQ ID NO: 685622 - DNA, 25 bp, Rattus norvegicus
ttgtgcttcccgtttcctggacact

SEQ ID NO: 685623 - DNA, 25 bp, Rattus norvegicus
ttgtgcttcgccataatagaccatc

SEQ ID NO: 685624 - DNA, 25 bp, Rattus norvegicus
ttgtgcttcgccttaatagaccatc

SEQ ID NO: 685625 - DNA, 25 bp, Rattus norvegicus
ttgtgcttctctcctattgtggata

SEQ ID NO: 685626 - DNA, 25 bp, Rattus norvegicus
ttgtgcttctctgctattgtggata

SEQ ID NO: 685627 - DNA, 25 bp, Rattus norvegicus
ttgtgcttctgtactctactagagt

SEQ ID NO: 685628 - DNA, 25 bp, Rattus norvegicus
ttgtgcttctgttctctactagagt

SEQ ID NO: 685629 - DNA, 25 bp, Rattus norvegicus
ttgtgcttgcctccgatgtctctaa

SEQ ID NO: 685630 - DNA, 25 bp, Rattus norvegicus
ttgtgcttgcctgcgatgtctctaa

SEQ ID NO: 685631 - DNA, 25 bp, Rattus norvegicus
ttgtgcttgctgagtaggattcctt

SEQ ID NO: 685632 - DNA, 25 bp, Rattus norvegicus
ttgtgcttgctgtgtaggattcctt

SEQ ID NO: 685633 - DNA, 25 bp, Rattus norvegicus
ttgtgcttggatcctgaagtggcct

SEQ ID NO: 685634 - DNA, 25 bp, Rattus norvegicus
ttgtgcttggatgctgaagtggcct

SEQ ID NO: 685635 - DNA, 25 bp, Rattus norvegicus
ttgtggaaacgcagcaccagaccca

SEQ ID NO: 685636 - DNA, 25 bp, Rattus norvegicus
ttgtggaaacgctgcaccagaccca

SEQ ID NO: 685637 - DNA, 25 bp, Rattus norvegicus
ttgtggaactatatggccccagcat

SEQ ID NO: 685638 - DNA, 25 bp, Rattus norvegicus
ttgtggaactatttggccccagcat

SEQ ID NO: 685639 - DNA, 25 bp, Rattus norvegicus
ttgtggaagcctcaagcgccattta

SEQ ID NO: 685640 - DNA, 25 bp, Rattus norvegicus
ttgtggaagcctgaagcgccattta

SEQ ID NO: 685641 - DNA, 25 bp, Rattus norvegicus
ttgtggaaggacctcacgagcttgt

SEQ ID NO: 685642 - DNA, 25 bp, Rattus norvegicus
ttgtggaaggacgtcacgagcttgt

SEQ ID NO: 685643 - DNA, 25 bp, Rattus norvegicus
ttgtggaagtttccccgccgtatga

SEQ ID NO: 685644 - DNA, 25 bp, Rattus norvegicus
ttgtggaagtttgcccgccgtatga

SEQ ID NO: 685645 - DNA, 25 bp, Rattus norvegicus
ttgtggacaacaattcatctcgaga

SEQ ID NO: 685646 - DNA, 25 bp, Rattus norvegicus
ttgtggacaacatttcatctcgaga

SEQ ID NO: 685647 - DNA, 25 bp, Rattus norvegicus
ttgtggacatgcacctgccttgctg

SEQ ID NO: 685648 - DNA, 25 bp, Rattus norvegicus
ttgtggacatgctcctgccttgctg

SEQ ID NO: 685649 - DNA, 25 bp, Rattus norvegicus
ttgtggacatggctgtggacatcct

SEQ ID NO: 685650 - DNA, 25 bp, Rattus norvegicus
ttgtggacatgggtgtggacatcct

SEQ ID NO: 685651 - DNA, 25 bp, Rattus norvegicus
ttgtggaccacactgttatcagcat

SEQ ID NO: 685652 - DNA, 25 bp, Rattus norvegicus
ttgtggaccacagtgttatcagcat

SEQ ID NO: 685653 - DNA, 25 bp, Rattus norvegicus
ttgtggacgctcctggtctcaccag

SEQ ID NO: 685654 - DNA, 25 bp, Rattus norvegicus
ttgtggacgctcgtggtctcaccag

SEQ ID NO: 685655 - DNA, 25 bp, Rattus norvegicus
ttgtggactctgaccttgttggtaa

SEQ ID NO: 685656 - DNA, 25 bp, Rattus norvegicus
ttgtggactctgtccttgttggtaa

SEQ ID NO: 685657 - DNA, 25 bp, Rattus norvegicus
ttgtggagacctacaaagctgaccc

SEQ ID NO: 685658 - DNA, 25 bp, Rattus norvegicus
ttgtggagaccttcaaagctgaccc

SEQ ID NO: 685659 - DNA, 25 bp, Rattus norvegicus
ttgtggagagctccagtctcagcct

SEQ ID NO: 685660 - DNA, 25 bp, Rattus norvegicus
ttgtggagagctgcagtctcagcct

SEQ ID NO: 685661 - DNA, 25 bp, Rattus norvegicus
ttgtggagatcgacctgggcgacca

SEQ ID NO: 685662 - DNA, 25 bp, Rattus norvegicus
ttgtggagatcgtcctgggcgacca

SEQ ID NO: 685663 - DNA, 25 bp, Rattus norvegicus
ttgtggaggagtactttgtggcccc

SEQ ID NO: 685664 - DNA, 25 bp, Rattus norvegicus
ttgtggaggagttctttgtggcccc

SEQ ID NO: 685665 - DNA, 25 bp, Rattus norvegicus
ttgtggaggctcctttaaccttgtt

SEQ ID NO: 685666 - DNA, 25 bp, Rattus norvegicus
ttgtggaggctcgtttaaccttgtt

SEQ ID NO: 685667 - DNA, 25 bp, Rattus norvegicus
ttgtggatatttctcctgcatcgga

SEQ ID NO: 685668 - DNA, 25 bp, Rattus norvegicus
ttgtggatatttgtcctgcatcgga

SEQ ID NO: 685669 - DNA, 25 bp, Rattus norvegicus
ttgtggatcccaacgggtacgggtc

SEQ ID NO: 685670 - DNA, 25 bp, Rattus norvegicus
ttgtggatcccatcgggtacgggtc

SEQ ID NO: 685671 - DNA, 25 bp, Rattus norvegicus
ttgtggattaccagtcccagccggt

SEQ ID NO: 685672 - DNA, 25 bp, Rattus norvegicus
ttgtggattacctgtcccagccggt

SEQ ID NO: 685673 - DNA, 25 bp, Rattus norvegicus
ttgtggcaaaaacttacctaagcgt

SEQ ID NO: 685674 - DNA, 25 bp, Rattus norvegicus
ttgtggcaaaaagttacctaagcgt

SEQ ID NO: 685675 - DNA, 25 bp, Rattus norvegicus
ttgtggcaacaacttccatcccagg

SEQ ID NO: 685676 - DNA, 25 bp, Rattus norvegicus
ttgtggcaacaagttccatcccagg

SEQ ID NO: 685677 - DNA, 25 bp, Rattus norvegicus
ttgtggcacacacctgctatttcag

SEQ ID NO: 685678 - DNA, 25 bp, Rattus norvegicus
ttgtggcacacagctgctatttcag

SEQ ID NO: 685679 - DNA, 25 bp, Rattus norvegicus
ttgtggcacactcccaagattgcgt

SEQ ID NO: 685680 - DNA, 25 bp, Rattus norvegicus
ttgtggcacactgccaagattgcgt

SEQ ID NO: 685681 - DNA, 25 bp, Rattus norvegicus
ttgtggcactgcaggccaagcctgt

SEQ ID NO: 685682 - DNA, 25 bp, Rattus norvegicus
ttgtggcactgctggccaagcctgt

SEQ ID NO: 685683 - DNA, 25 bp, Rattus norvegicus
ttgtggcagtacacagcccagcgaa

SEQ ID NO: 685684 - DNA, 25 bp, Rattus norvegicus
ttgtggcagtactcagcccagcgaa

SEQ ID NO: 685685 - DNA, 25 bp, Rattus norvegicus
ttgtggcatcctataccacttcaca

SEQ ID NO: 685686 - DNA, 25 bp, Rattus norvegicus
ttgtggcatcctttaccacttcaca

SEQ ID NO: 685687 - DNA, 25 bp, Rattus norvegicus
ttgtggcattagatcttcatgtttc

SEQ ID NO: 685688 - DNA, 25 bp, Rattus norvegicus
ttgtggcattagttcttcatgtttc

SEQ ID NO: 685689 - DNA, 25 bp, Rattus norvegicus
ttgtggcatttcaaccaaggacccc

SEQ ID NO: 685690 - DNA, 25 bp, Rattus norvegicus
ttgtggcatttctaccaaggacccc

SEQ ID NO: 685691 - DNA, 25 bp, Rattus norvegicus
ttgtggccacacaagagaaggaaga

SEQ ID NO: 685692 - DNA, 25 bp, Rattus norvegicus
ttgtggccacactagagaaggaaga

SEQ ID NO: 685693 - DNA, 25 bp, Rattus norvegicus
ttgtggccacagatatctgccctgt

SEQ ID NO: 685694 - DNA, 25 bp, Rattus norvegicus
ttgtggccacagttatctgccctgt

SEQ ID NO: 685695 - DNA, 25 bp, Rattus norvegicus
ttgtggccagataagaacgacagct

SEQ ID NO: 685696 - DNA, 25 bp, Rattus norvegicus
ttgtggccagattagaacgacagct

SEQ ID NO: 685697 - DNA, 25 bp, Rattus norvegicus
ttgtggccagttactgctcctcaga

SEQ ID NO: 685698 - DNA, 25 bp, Rattus norvegicus
ttgtggccagtttctgctcctcaga

SEQ ID NO: 685699 - DNA, 25 bp, Rattus norvegicus
ttgtggccatggagctcagtgtcgt

SEQ ID NO: 685700 - DNA, 25 bp, Rattus norvegicus
ttgtggccatggtgctcagtgtcgt

SEQ ID NO: 685701 - DNA, 25 bp, Rattus norvegicus
ttgtggcccctaaagcccataaaga

SEQ ID NO: 685702 - DNA, 25 bp, Rattus norvegicus
ttgtggcccctatagcccataaaga

SEQ ID NO: 685703 - DNA, 25 bp, Rattus norvegicus
ttgtggcccgctaaaattctctgtg

SEQ ID NO: 685704 - DNA, 25 bp, Rattus norvegicus
ttgtggcccgcttaaattctctgtg

SEQ ID NO: 685705 - DNA, 25 bp, Rattus norvegicus
ttgtggccctgaaaagttccgctat

SEQ ID NO: 685706 - DNA, 25 bp, Rattus norvegicus
ttgtggccctgataagttccgctat

SEQ ID NO: 685707 - DNA, 25 bp, Rattus norvegicus
ttgtggcccttgattgcctttctca

SEQ ID NO: 685708 - DNA, 25 bp, Rattus norvegicus
ttgtggcccttgtttgcctttctca

SEQ ID NO: 685709 - DNA, 25 bp, Rattus norvegicus
ttgtggccgaacctttctgactcat

SEQ ID NO: 685710 - DNA, 25 bp, Rattus norvegicus
ttgtggccgaacgtttctgactcat

SEQ ID NO: 685711 - DNA, 25 bp, Rattus norvegicus
ttgtggcctctgaataagttcctgc

SEQ ID NO: 685712 - DNA, 25 bp, Rattus norvegicus
ttgtggcctctgtataagttcctgc

SEQ ID NO: 685713 - DNA, 25 bp, Rattus norvegicus
ttgtggcctgctctattttacaagc

SEQ ID NO: 685714 - DNA, 25 bp, Rattus norvegicus
ttgtggcctgctgtattttacaagc

SEQ ID NO: 685715 - DNA, 25 bp, Rattus norvegicus
ttgtggccttaacctatcctttgca

SEQ ID NO: 685716 - DNA, 25 bp, Rattus norvegicus
ttgtggccttaagctatcctttgca

SEQ ID NO: 685717 - DNA, 25 bp, Rattus norvegicus
ttgtggccttggacatgaagtactc

SEQ ID NO: 685718 - DNA, 25 bp, Rattus norvegicus
ttgtggccttggtcatgaagtactc

SEQ ID NO: 685719 - DNA, 25 bp, Rattus norvegicus
ttgtggcgctaaacctttcgcatcc

SEQ ID NO: 685720 - DNA, 25 bp, Rattus norvegicus
ttgtggcgctaatcctttcgcatcc

SEQ ID NO: 685721 - DNA, 25 bp, Rattus norvegicus
ttgtggcgctgcattgagatggacc

SEQ ID NO: 685722 - DNA, 25 bp, Rattus norvegicus
ttgtggcgctgctttgagatggacc

SEQ ID NO: 685723 - DNA, 25 bp, Rattus norvegicus
ttgtggcggaaacccttgccgcagt

SEQ ID NO: 685724 - DNA, 25 bp, Rattus norvegicus
ttgtggcggaaagccttgccgcagt

SEQ ID NO: 685725 - DNA, 25 bp, Rattus norvegicus
ttgtggctcccgaaaagctggctga

SEQ ID NO: 685726 - DNA, 25 bp, Rattus norvegicus
ttgtggctcccgtaaagctggctga

SEQ ID NO: 685727 - DNA, 25 bp, Rattus norvegicus
ttgtggctcctcagagttttgcaac

SEQ ID NO: 685728 - DNA, 25 bp, Rattus norvegicus
ttgtggctcctctgagttttgcaac

SEQ ID NO: 685729 - DNA, 25 bp, Rattus norvegicus
ttgtggctgacgaagtgtgctccag

SEQ ID NO: 685730 - DNA, 25 bp, Rattus norvegicus
ttgtggctgacgtagtgtgctccag

SEQ ID NO: 685731 - DNA, 25 bp, Rattus norvegicus
ttgtggctgatgagctgggaaacca

SEQ ID NO: 685732 - DNA, 25 bp, Rattus norvegicus
ttgtggctgatgctctgtgatgtct

SEQ ID NO: 685733 - DNA, 25 bp, Rattus norvegicus
ttgtggctgatggtctgtgatgtct

SEQ ID NO: 685734 - DNA, 25 bp, Rattus norvegicus
ttgtggctgatgtgctgggaaacca

SEQ ID NO: 685735 - DNA, 25 bp, Rattus norvegicus
ttgtggctgcagagtttgtcctgca

SEQ ID NO: 685736 - DNA, 25 bp, Rattus norvegicus
ttgtggctgcagtgtttgtcctgca

SEQ ID NO: 685737 - DNA, 25 bp, Rattus norvegicus
ttgtggctgggacaaataccctgac

SEQ ID NO: 685738 - DNA, 25 bp, Rattus norvegicus
ttgtggctgggagaaataccctgac

SEQ ID NO: 685739 - DNA, 25 bp, Rattus norvegicus
ttgtggctgtcaacctctactttga

SEQ ID NO: 685740 - DNA, 25 bp, Rattus norvegicus
ttgtggctgtcatcctctactttga

SEQ ID NO: 685741 - DNA, 25 bp, Rattus norvegicus
ttgtggcttacaacttttcctctgg

SEQ ID NO: 685742 - DNA, 25 bp, Rattus norvegicus
ttgtggcttacatcttttcctctgg

SEQ ID NO: 685743 - DNA, 25 bp, Rattus norvegicus
ttgtggcttaccatgtggccgtcac

SEQ ID NO: 685744 - DNA, 25 bp, Rattus norvegicus
ttgtggcttaccttgtggccgtcac

SEQ ID NO: 685745 - DNA, 25 bp, Rattus norvegicus
ttgtggcttctcagaccagatgtgc

SEQ ID NO: 685746 - DNA, 25 bp, Rattus norvegicus
ttgtggcttctctgaccagatgtgc

SEQ ID NO: 685747 - DNA, 25 bp, Rattus norvegicus
ttgtggcttctgaacttcttgatac

SEQ ID NO: 685748 - DNA, 25 bp, Rattus norvegicus
ttgtggcttctgtacttcttgatac

SEQ ID NO: 685749 - DNA, 25 bp, Rattus norvegicus
ttgtggcttgctattccaactgaat

SEQ ID NO: 685750 - DNA, 25 bp, Rattus norvegicus
ttgtggcttgcttttccaactgaat

SEQ ID NO: 685751 - DNA, 25 bp, Rattus norvegicus
ttgtggcttttgaggaatagtgttc

SEQ ID NO: 685752 - DNA, 25 bp, Rattus norvegicus
ttgtggcttttgtggaatagtgttc

SEQ ID NO: 685753 - DNA, 25 bp, Rattus norvegicus
ttgtgggaaccaaggcccagcactg

SEQ ID NO: 685754 - DNA, 25 bp, Rattus norvegicus
ttgtgggaaccatggcccagcactg

SEQ ID NO: 685755 - DNA, 25 bp, Rattus norvegicus
ttgtgggaagtacctttagcccctg

SEQ ID NO: 685756 - DNA, 25 bp, Rattus norvegicus
ttgtgggaagtagctttagcccctg

SEQ ID NO: 685757 - DNA, 25 bp, Rattus norvegicus
ttgtgggaatctctgtgaccagtga

SEQ ID NO: 685758 - DNA, 25 bp, Rattus norvegicus
ttgtgggaatctgtgtgaccagtga

SEQ ID NO: 685759 - DNA, 25 bp, Rattus norvegicus
ttgtgggacagcaatcaggaattca

SEQ ID NO: 685760 - DNA, 25 bp, Rattus norvegicus
ttgtgggacagctatcaggaattca

SEQ ID NO: 685761 - DNA, 25 bp, Rattus norvegicus
ttgtgggactatagcctaccctcat

SEQ ID NO: 685762 - DNA, 25 bp, Rattus norvegicus
ttgtgggactattgcctaccctcat

SEQ ID NO: 685763 - DNA, 25 bp, Rattus norvegicus
ttgtgggactctccatggtcattgg

SEQ ID NO: 685764 - DNA, 25 bp, Rattus norvegicus
ttgtgggactctgcatggtcattgg

SEQ ID NO: 685765 - DNA, 25 bp, Rattus norvegicus
ttgtgggagcctataccttctgaag

SEQ ID NO: 685766 - DNA, 25 bp, Rattus norvegicus
ttgtgggagcctttaccttctgaag

SEQ ID NO: 685767 - DNA, 25 bp, Rattus norvegicus
ttgtgggatcctatgttacctcaac

SEQ ID NO: 685768 - DNA, 25 bp, Rattus norvegicus
ttgtgggatcctttgttacctcaac

SEQ ID NO: 685769 - DNA, 25 bp, Rattus norvegicus
ttgtgggattacctcagcatcctat

SEQ ID NO: 685770 - DNA, 25 bp, Rattus norvegicus
ttgtgggattacgtcagcatcctat

SEQ ID NO: 685771 - DNA, 25 bp, Rattus norvegicus
ttgtgggatttcaggtgggctctac

SEQ ID NO: 685772 - DNA, 25 bp, Rattus norvegicus
ttgtgggatttctggtgggctctac

SEQ ID NO: 685773 - DNA, 25 bp, Rattus norvegicus
ttgtgggattttagctgccgggact

SEQ ID NO: 685774 - DNA, 25 bp, Rattus norvegicus
ttgtgggatttttgctgccgggact

SEQ ID NO: 685775 - DNA, 25 bp, Rattus norvegicus
ttgtgggcaatgcttctggcttaag

SEQ ID NO: 685776 - DNA, 25 bp, Rattus norvegicus
ttgtgggcaatggttctggcttaag

SEQ ID NO: 685777 - DNA, 25 bp, Rattus norvegicus
ttgtgggcaccaaatctttagcttg

SEQ ID NO: 685778 - DNA, 25 bp, Rattus norvegicus
ttgtgggcaccacaacaagcacctc

SEQ ID NO: 685779 - DNA, 25 bp, Rattus norvegicus
ttgtgggcaccagaacaagcacctc

SEQ ID NO: 685780 - DNA, 25 bp, Rattus norvegicus
ttgtgggcaccatatctttagcttg

SEQ ID NO: 685781 - DNA, 25 bp, Rattus norvegicus
ttgtgggcacccaagactagttgtt

SEQ ID NO: 685782 - DNA, 25 bp, Rattus norvegicus
ttgtgggcaccctagactagttgtt

SEQ ID NO: 685783 - DNA, 25 bp, Rattus norvegicus
ttgtgggcatgtctgtatccttcca

SEQ ID NO: 685784 - DNA, 25 bp, Rattus norvegicus
ttgtgggcatgtgtgtatccttcca

SEQ ID NO: 685785 - DNA, 25 bp, Rattus norvegicus
ttgtgggcccaacacctgattacag

SEQ ID NO: 685786 - DNA, 25 bp, Rattus norvegicus
ttgtgggcccaagacctgattacag

SEQ ID NO: 685787 - DNA, 25 bp, Rattus norvegicus
ttgtgggctaccagggtcctctgct

SEQ ID NO: 685788 - DNA, 25 bp, Rattus norvegicus
ttgtgggctacctgggtcctctgct

SEQ ID NO: 685789 - DNA, 25 bp, Rattus norvegicus
ttgtgggctcctccataggtatata

SEQ ID NO: 685790 - DNA, 25 bp, Rattus norvegicus
ttgtgggctcctgcataggtatata

SEQ ID NO: 685791 - DNA, 25 bp, Rattus norvegicus
ttgtgggctgcaagtgggtctccaa

SEQ ID NO: 685792 - DNA, 25 bp, Rattus norvegicus
ttgtgggctgcatgtgggtctccaa

SEQ ID NO: 685793 - DNA, 25 bp, Rattus norvegicus
ttgtgggcttttacactaaactgtg

SEQ ID NO: 685794 - DNA, 25 bp, Rattus norvegicus
ttgtgggctttttcactaaactgtg

SEQ ID NO: 685795 - DNA, 25 bp, Rattus norvegicus
ttgtgggtaacaccatgtgcacctt

SEQ ID NO: 685796 - DNA, 25 bp, Rattus norvegicus
ttgtgggtaacagcatgtgcacctt

SEQ ID NO: 685797 - DNA, 25 bp, Rattus norvegicus
ttgtgggtacccatcctaggaagct

SEQ ID NO: 685798 - DNA, 25 bp, Rattus norvegicus
ttgtgggtacccttcctaggaagct

SEQ ID NO: 685799 - DNA, 25 bp, Rattus norvegicus
ttgtgggtcccactcaactgtagta

SEQ ID NO: 685800 - DNA, 25 bp, Rattus norvegicus
ttgtgggtcccagtcaactgtagta

SEQ ID NO: 685801 - DNA, 25 bp, Rattus norvegicus
ttgtgggtgcaaaagattccttctt

SEQ ID NO: 685802 - DNA, 25 bp, Rattus norvegicus
ttgtgggtgcaatagattccttctt

SEQ ID NO: 685803 - DNA, 25 bp, Rattus norvegicus
ttgtgggtgctcaatggtatcataa

SEQ ID NO: 685804 - DNA, 25 bp, Rattus norvegicus
ttgtgggtgctctatggtatcataa

SEQ ID NO: 685805 - DNA, 25 bp, Rattus norvegicus
ttgtgggtgtcgctagtacagcaaa

SEQ ID NO: 685806 - DNA, 25 bp, Rattus norvegicus
ttgtgggtgtcggtagtacagcaaa

SEQ ID NO: 685807 - DNA, 25 bp, Rattus norvegicus
ttgtgggttaatactctttcctgaa

SEQ ID NO: 685808 - DNA, 25 bp, Rattus norvegicus
ttgtgggttaattctctttcctgaa

SEQ ID NO: 685809 - DNA, 25 bp, Rattus norvegicus
ttgtgggttgaactctggtgcttcc

SEQ ID NO: 685810 - DNA, 25 bp, Rattus norvegicus
ttgtgggttgaagtctggtgcttcc

SEQ ID NO: 685811 - DNA, 25 bp, Rattus norvegicus
ttgtggtaacccctttgatgaattt

SEQ ID NO: 685812 - DNA, 25 bp, Rattus norvegicus
ttgtggtaacccgtttgatgaattt

SEQ ID NO: 685813 - DNA, 25 bp, Rattus norvegicus
ttgtggtaatgacctgtctcagggc

SEQ ID NO: 685814 - DNA, 25 bp, Rattus norvegicus
ttgtggtaatgagctgtctcagggc

SEQ ID NO: 685815 - DNA, 25 bp, Rattus norvegicus
ttgtggtaatgcagactcctgtttt

SEQ ID NO: 685816 - DNA, 25 bp, Rattus norvegicus
ttgtggtaatgctgactcctgtttt

SEQ ID NO: 685817 - DNA, 25 bp, Rattus norvegicus
ttgtggtaccttacactggtaagta

SEQ ID NO: 685818 - DNA, 25 bp, Rattus norvegicus
ttgtggtacctttcactggtaagta

SEQ ID NO: 685819 - DNA, 25 bp, Rattus norvegicus
ttgtggtcagacatggcctgctttc

SEQ ID NO: 685820 - DNA, 25 bp, Rattus norvegicus
ttgtggtcagacttggcctgctttc

SEQ ID NO: 685821 - DNA, 25 bp, Rattus norvegicus
ttgtggtcagctcagtctgtgtgta

SEQ ID NO: 685822 - DNA, 25 bp, Rattus norvegicus
ttgtggtcagctgagtctgtgtgta

SEQ ID NO: 685823 - DNA, 25 bp, Rattus norvegicus
ttgtggtcatcaacggacccattct

SEQ ID NO: 685824 - DNA, 25 bp, Rattus norvegicus
ttgtggtcatcatcggacccattct

SEQ ID NO: 685825 - DNA, 25 bp, Rattus norvegicus
ttgtggtcccatccttgcttcaaag

SEQ ID NO: 685826 - DNA, 25 bp, Rattus norvegicus
ttgtggtcccatgcttgcttcaaag

SEQ ID NO: 685827 - DNA, 25 bp, Rattus norvegicus
ttgtggtcgatcactgagcgttgtt

SEQ ID NO: 685828 - DNA, 25 bp, Rattus norvegicus
ttgtggtcgatctctgagcgttgtt

SEQ ID NO: 685829 - DNA, 25 bp, Rattus norvegicus
ttgtggtctaggaaggcctctcgca

SEQ ID NO: 685830 - DNA, 25 bp, Rattus norvegicus
ttgtggtctaggtaggcctctcgca

SEQ ID NO: 685831 - DNA, 25 bp, Rattus norvegicus
ttgtggtctcctcctaatatagtag

SEQ ID NO: 685832 - DNA, 25 bp, Rattus norvegicus
ttgtggtctcctgctaatatagtag

SEQ ID NO: 685833 - DNA, 25 bp, Rattus norvegicus
ttgtggtctgatattcttctgtgag

SEQ ID NO: 685834 - DNA, 25 bp, Rattus norvegicus
ttgtggtctgattttcttctgtgag

SEQ ID NO: 685835 - DNA, 25 bp, Rattus norvegicus
ttgtggtctgtaagattctgcggtc

SEQ ID NO: 685836 - DNA, 25 bp, Rattus norvegicus
ttgtggtctgtatgattctgcggtc

SEQ ID NO: 685837 - DNA, 25 bp, Rattus norvegicus
ttgtggtcttcacggctctggcacc

SEQ ID NO: 685838 - DNA, 25 bp, Rattus norvegicus
ttgtggtcttcagggctctggcacc

SEQ ID NO: 685839 - DNA, 25 bp, Rattus norvegicus
ttgtggtgacccatgtgttatttcc

SEQ ID NO: 685840 - DNA, 25 bp, Rattus norvegicus
ttgtggtgacccttgtgttatttcc

SEQ ID NO: 685841 - DNA, 25 bp, Rattus norvegicus
ttgtggtgagcaacatcggcagctt

SEQ ID NO: 685842 - DNA, 25 bp, Rattus norvegicus
ttgtggtgagcatcatcggcagctt

SEQ ID NO: 685843 - DNA, 25 bp, Rattus norvegicus
ttgtggtgatttatcctgcctctgc

SEQ ID NO: 685844 - DNA, 25 bp, Rattus norvegicus
ttgtggtgatttttcctgcctctgc

SEQ ID NO: 685845 - DNA, 25 bp, Rattus norvegicus
ttgtggtgctaactttgtgtccgtc

SEQ ID NO: 685846 - DNA, 25 bp, Rattus norvegicus
ttgtggtgctaagtttgtgtccgtc

SEQ ID NO: 685847 - DNA, 25 bp, Rattus norvegicus
ttgtggtgggatcctgataccgttc

SEQ ID NO: 685848 - DNA, 25 bp, Rattus norvegicus
ttgtggtgggatgctgataccgttc

SEQ ID NO: 685849 - DNA, 25 bp, Rattus norvegicus
ttgtggtgtatcctccatgctgaac

SEQ ID NO: 685850 - DNA, 25 bp, Rattus norvegicus
ttgtggtgtatcgtccatgctgaac

SEQ ID NO: 685851 - DNA, 25 bp, Rattus norvegicus
ttgtggtgttggaacccacaccaat

SEQ ID NO: 685852 - DNA, 25 bp, Rattus norvegicus
ttgtggtgttggtacccacaccaat

SEQ ID NO: 685853 - DNA, 25 bp, Rattus norvegicus
ttgtggtgttttcactactcggttg

SEQ ID NO: 685854 - DNA, 25 bp, Rattus norvegicus
ttgtggtgttttgactactcggttg

SEQ ID NO: 685855 - DNA, 25 bp, Rattus norvegicus
ttgtggttaccaatgtcagctctga

SEQ ID NO: 685856 - DNA, 25 bp, Rattus norvegicus
ttgtggttaccattgtcagctctga

SEQ ID NO: 685857 - DNA, 25 bp, Rattus norvegicus
ttgtggttacgcagggaactccctc

SEQ ID NO: 685858 - DNA, 25 bp, Rattus norvegicus
ttgtggttacgctgggaactccctc

SEQ ID NO: 685859 - DNA, 25 bp, Rattus norvegicus
ttgtggttaggtcccgtatgtacat

SEQ ID NO: 685860 - DNA, 25 bp, Rattus norvegicus
ttgtggttaggtgccgtatgtacat

SEQ ID NO: 685861 - DNA, 25 bp, Rattus norvegicus
ttgtggttcacaacacggacgtgtt

SEQ ID NO: 685862 - DNA, 25 bp, Rattus norvegicus
ttgtggttcacatcacggacgtgtt

SEQ ID NO: 685863 - DNA, 25 bp, Rattus norvegicus
ttgtggttcattaggtggcatcctg

SEQ ID NO: 685864 - DNA, 25 bp, Rattus norvegicus
ttgtggttcatttggtggcatcctg

SEQ ID NO: 685865 - DNA, 25 bp, Rattus norvegicus
ttgtggttcctaagccccgaagtga

SEQ ID NO: 685866 - DNA, 25 bp, Rattus norvegicus
ttgtggttcctatgccccgaagtga

SEQ ID NO: 685867 - DNA, 25 bp, Rattus norvegicus
ttgtggttcttcatgtcctctgtaa

SEQ ID NO: 685868 - DNA, 25 bp, Rattus norvegicus
ttgtggttcttcttgtcctctgtaa

SEQ ID NO: 685869 - DNA, 25 bp, Rattus norvegicus
ttgtggttgctaccagctgtggaca

SEQ ID NO: 685870 - DNA, 25 bp, Rattus norvegicus
ttgtggttgctagcagctgtggaca

SEQ ID NO: 685871 - DNA, 25 bp, Rattus norvegicus
ttgtggttgctgagtctgcggctgc

SEQ ID NO: 685872 - DNA, 25 bp, Rattus norvegicus
ttgtggttgctgtgtctgcggctgc

SEQ ID NO: 685873 - DNA, 25 bp, Rattus norvegicus
ttgtggtttccaactggccagaaat

SEQ ID NO: 685874 - DNA, 25 bp, Rattus norvegicus
ttgtggtttccaagtcactctgtag

SEQ ID NO: 685875 - DNA, 25 bp, Rattus norvegicus
ttgtggtttccatctggccagaaat

SEQ ID NO: 685876 - DNA, 25 bp, Rattus norvegicus
ttgtggtttccatgtcactctgtag

SEQ ID NO: 685877 - DNA, 25 bp, Rattus norvegicus
ttgtggtttgccctaagatatctgt

SEQ ID NO: 685878 - DNA, 25 bp, Rattus norvegicus
ttgtggtttgccgtaagatatctgt

SEQ ID NO: 685879 - DNA, 25 bp, Rattus norvegicus
ttgtgtaacactatcgtggagactg

SEQ ID NO: 685880 - DNA, 25 bp, Rattus norvegicus
ttgtgtaacactttcgtggagactg

SEQ ID NO: 685881 - DNA, 25 bp, Rattus norvegicus
ttgtgtaactcgcagtaaccttccg

SEQ ID NO: 685882 - DNA, 25 bp, Rattus norvegicus
ttgtgtaactcggagtaaccttccg

SEQ ID NO: 685883 - DNA, 25 bp, Rattus norvegicus
ttgtgtaagcagaattgtgagagtg

SEQ ID NO: 685884 - DNA, 25 bp, Rattus norvegicus
ttgtgtaagcagtattgtgagagtg

SEQ ID NO: 685885 - DNA, 25 bp, Rattus norvegicus
ttgtgtacagtcaggtgtttgtttt

SEQ ID NO: 685886 - DNA, 25 bp, Rattus norvegicus
ttgtgtacagtctggtgtttgtttt

SEQ ID NO: 685887 - DNA, 25 bp, Rattus norvegicus
ttgtgtacagttccctttgtagcaa

SEQ ID NO: 685888 - DNA, 25 bp, Rattus norvegicus
ttgtgtacagttgcctttgtagcaa

SEQ ID NO: 685889 - DNA, 25 bp, Rattus norvegicus
ttgtgtaccacacggagtctcagct

SEQ ID NO: 685890 - DNA, 25 bp, Rattus norvegicus
ttgtgtaccacagggagtctcagct

SEQ ID NO: 685891 - DNA, 25 bp, Rattus norvegicus
ttgtgtacccatcatgtcactgtgg

SEQ ID NO: 685892 - DNA, 25 bp, Rattus norvegicus
ttgtgtacccatgatgtcactgtgg

SEQ ID NO: 685893 - DNA, 25 bp, Rattus norvegicus
ttgtgtacggtaagtttccaccgct

SEQ ID NO: 685894 - DNA, 25 bp, Rattus norvegicus
ttgtgtacggtatgtttccaccgct

SEQ ID NO: 685895 - DNA, 25 bp, Rattus norvegicus
ttgtgtacggtcaagtaattctgtt

SEQ ID NO: 685896 - DNA, 25 bp, Rattus norvegicus
ttgtgtacggtctagtaattctgtt

SEQ ID NO: 685897 - DNA, 25 bp, Rattus norvegicus
ttgtgtactcctacagttttgctga

SEQ ID NO: 685898 - DNA, 25 bp, Rattus norvegicus
ttgtgtactccttcagttttgctga

SEQ ID NO: 685899 - DNA, 25 bp, Rattus norvegicus
ttgtgtactggaacctgatgctgtt

SEQ ID NO: 685900 - DNA, 25 bp, Rattus norvegicus
ttgtgtactggatcctgatgctgtt

SEQ ID NO: 685901 - DNA, 25 bp, Rattus norvegicus
ttgtgtacttacaggcagctttttg

SEQ ID NO: 685902 - DNA, 25 bp, Rattus norvegicus
ttgtgtacttactggcagctttttg

SEQ ID NO: 685903 - DNA, 25 bp, Rattus norvegicus
ttgtgtacttggagttctgggcatt

SEQ ID NO: 685904 - DNA, 25 bp, Rattus norvegicus
ttgtgtacttggtgttctgggcatt

SEQ ID NO: 685905 - DNA, 25 bp, Rattus norvegicus
ttgtgtagagccagaacccaaaccc

SEQ ID NO: 685906 - DNA, 25 bp, Rattus norvegicus
ttgtgtagagcctgaacccaaaccc

SEQ ID NO: 685907 - DNA, 25 bp, Rattus norvegicus
ttgtgtagagctaccctactgtgtt

SEQ ID NO: 685908 - DNA, 25 bp, Rattus norvegicus
ttgtgtagagcttccctactgtgtt

SEQ ID NO: 685909 - DNA, 25 bp, Rattus norvegicus
ttgtgtagcaccagcattcaacttc

SEQ ID NO: 685910 - DNA, 25 bp, Rattus norvegicus
ttgtgtagcacctgcattcaacttc

SEQ ID NO: 685911 - DNA, 25 bp, Rattus norvegicus
ttgtgtagcattccatctcacgctg

SEQ ID NO: 685912 - DNA, 25 bp, Rattus norvegicus
ttgtgtagcattgcatctcacgctg

SEQ ID NO: 685913 - DNA, 25 bp, Rattus norvegicus
ttgtgtatatttatcatgcctcttg

SEQ ID NO: 685914 - DNA, 25 bp, Rattus norvegicus
ttgtgtatatttttcatgcctcttg

SEQ ID NO: 685915 - DNA, 25 bp, Rattus norvegicus
ttgtgtatcattatggctccaccac

SEQ ID NO: 685916 - DNA, 25 bp, Rattus norvegicus
ttgtgtatcattttggctccaccac

SEQ ID NO: 685917 - DNA, 25 bp, Rattus norvegicus
ttgtgtatctgtcccaaggtgactg

SEQ ID NO: 685918 - DNA, 25 bp, Rattus norvegicus
ttgtgtatctgtgccaaggtgactg

SEQ ID NO: 685919 - DNA, 25 bp, Rattus norvegicus
ttgtgtatcttgaccacatctgtgg

SEQ ID NO: 685920 - DNA, 25 bp, Rattus norvegicus
ttgtgtatcttgtccacatctgtgg

SEQ ID NO: 685921 - DNA, 25 bp, Rattus norvegicus
ttgtgtatctttataaccccagcct

SEQ ID NO: 685922 - DNA, 25 bp, Rattus norvegicus
ttgtgtatctttttaaccccagcct

SEQ ID NO: 685923 - DNA, 25 bp, Rattus norvegicus
ttgtgtatgagcctgggcgcctaca

SEQ ID NO: 685924 - DNA, 25 bp, Rattus norvegicus
ttgtgtatgagcgtgggcgcctaca

SEQ ID NO: 685925 - DNA, 25 bp, Rattus norvegicus
ttgtgtatgctgcactgcgggcgac

SEQ ID NO: 685926 - DNA, 25 bp, Rattus norvegicus
ttgtgtatgctggactgcgggcgac

SEQ ID NO: 685927 - DNA, 25 bp, Rattus norvegicus
ttgtgtatggtcatcaggccttgca

SEQ ID NO: 685928 - DNA, 25 bp, Rattus norvegicus
ttgtgtatggtcttcaggccttgca

SEQ ID NO: 685929 - DNA, 25 bp, Rattus norvegicus
ttgtgtcaatcactggcaactgagt

SEQ ID NO: 685930 - DNA, 25 bp, Rattus norvegicus
ttgtgtcaatcagtggcaactgagt

SEQ ID NO: 685931 - DNA, 25 bp, Rattus norvegicus
ttgtgtcacatcaaccttgggatat

SEQ ID NO: 685932 - DNA, 25 bp, Rattus norvegicus
ttgtgtcacatctaccttgggatat

SEQ ID NO: 685933 - DNA, 25 bp, Rattus norvegicus
ttgtgtcagcgtctcttccgataga

SEQ ID NO: 685934 - DNA, 25 bp, Rattus norvegicus
ttgtgtcagcgtgtcttccgataga

SEQ ID NO: 685935 - DNA, 25 bp, Rattus norvegicus
ttgtgtccaaatatcagcccagttc

SEQ ID NO: 685936 - DNA, 25 bp, Rattus norvegicus
ttgtgtccaaatttcagcccagttc

SEQ ID NO: 685937 - DNA, 25 bp, Rattus norvegicus
ttgtgtccacctaggtgcactggga

SEQ ID NO: 685938 - DNA, 25 bp, Rattus norvegicus
ttgtgtccaccttggtgcactggga

SEQ ID NO: 685939 - DNA, 25 bp, Rattus norvegicus
ttgtgtccagagacctgaccgttaa

SEQ ID NO: 685940 - DNA, 25 bp, Rattus norvegicus
ttgtgtccagagtcctgaccgttaa

SEQ ID NO: 685941 - DNA, 25 bp, Rattus norvegicus
ttgtgtccatgtccccttgaaacaa

SEQ ID NO: 685942 - DNA, 25 bp, Rattus norvegicus
ttgtgtccatgtgcccttgaaacaa

SEQ ID NO: 685943 - DNA, 25 bp, Rattus norvegicus
ttgtgtccccctaaatggcctttca

SEQ ID NO: 685944 - DNA, 25 bp, Rattus norvegicus
ttgtgtcccccttaatggcctttca

SEQ ID NO: 685945 - DNA, 25 bp, Rattus norvegicus
ttgtgtccctccaactgattttaaa

SEQ ID NO: 685946 - DNA, 25 bp, Rattus norvegicus
ttgtgtccctcctactgattttaaa

SEQ ID NO: 685947 - DNA, 25 bp, Rattus norvegicus
ttgtgtccctgtaaagccagctgat

SEQ ID NO: 685948 - DNA, 25 bp, Rattus norvegicus
ttgtgtccctgttaagccagctgat

SEQ ID NO: 685949 - DNA, 25 bp, Rattus norvegicus
ttgtgtccgtctatataaactatta

SEQ ID NO: 685950 - DNA, 25 bp, Rattus norvegicus
ttgtgtccgtctttataaactatta

SEQ ID NO: 685951 - DNA, 25 bp, Rattus norvegicus
ttgtgtcctagtagagctgtgctca

SEQ ID NO: 685952 - DNA, 25 bp, Rattus norvegicus
ttgtgtcctagttgagctgtgctca

SEQ ID NO: 685953 - DNA, 25 bp, Rattus norvegicus
ttgtgtcctatgatgcaagatcatg

SEQ ID NO: 685954 - DNA, 25 bp, Rattus norvegicus
ttgtgtcctatgttgcaagatcatg

SEQ ID NO: 685955 - DNA, 25 bp, Rattus norvegicus
ttgtgtcctcacatgcattaaagct

SEQ ID NO: 685956 - DNA, 25 bp, Rattus norvegicus
ttgtgtcctcacttgcattaaagct

SEQ ID NO: 685957 - DNA, 25 bp, Rattus norvegicus
ttgtgtcctcctagtaatttagcct

SEQ ID NO: 685958 - DNA, 25 bp, Rattus norvegicus
ttgtgtcctccttgtaatttagcct

SEQ ID NO: 685959 - DNA, 25 bp, Rattus norvegicus
ttgtgtcctgctcccggactggtga

SEQ ID NO: 685960 - DNA, 25 bp, Rattus norvegicus
ttgtgtcctgctcctcggaacactg

SEQ ID NO: 685961 - DNA, 25 bp, Rattus norvegicus
ttgtgtcctgctgccggactggtga

SEQ ID NO: 685962 - DNA, 25 bp, Rattus norvegicus
ttgtgtcctgctgctcggaacactg

SEQ ID NO: 685963 - DNA, 25 bp, Rattus norvegicus
ttgtgtcctggcaccctgcggtggt

SEQ ID NO: 685964 - DNA, 25 bp, Rattus norvegicus
ttgtgtcctggctccctgcggtggt

SEQ ID NO: 685965 - DNA, 25 bp, Rattus norvegicus
ttgtgtccttcacctgctaacggaa

SEQ ID NO: 685966 - DNA, 25 bp, Rattus norvegicus
ttgtgtccttcactgagcctgagac

SEQ ID NO: 685967 - DNA, 25 bp, Rattus norvegicus
ttgtgtccttcagctgctaacggaa

SEQ ID NO: 685968 - DNA, 25 bp, Rattus norvegicus
ttgtgtccttcagtgagcctgagac

SEQ ID NO: 685969 - DNA, 25 bp, Rattus norvegicus
ttgtgtcgttctcttctcaaaagac

SEQ ID NO: 685970 - DNA, 25 bp, Rattus norvegicus
ttgtgtcgttctgttctcaaaagac

SEQ ID NO: 685971 - DNA, 25 bp, Rattus norvegicus
ttgtgtctaacccacatttggctgt

SEQ ID NO: 685972 - DNA, 25 bp, Rattus norvegicus
ttgtgtctaaccgacatttggctgt

SEQ ID NO: 685973 - DNA, 25 bp, Rattus norvegicus
ttgtgtctagagacctaacagtgct

SEQ ID NO: 685974 - DNA, 25 bp, Rattus norvegicus
ttgtgtctagagtcctaacagtgct

SEQ ID NO: 685975 - DNA, 25 bp, Rattus norvegicus
ttgtgtctcaagagccctgacccag

SEQ ID NO: 685976 - DNA, 25 bp, Rattus norvegicus
ttgtgtctcaagtgccctgacccag

SEQ ID NO: 685977 - DNA, 25 bp, Rattus norvegicus
ttgtgtctcactaatgggtctgcat

SEQ ID NO: 685978 - DNA, 25 bp, Rattus norvegicus
ttgtgtctcacttatgggtctgcat

SEQ ID NO: 685979 - DNA, 25 bp, Rattus norvegicus
ttgtgtctcattctgcagtgtggat

SEQ ID NO: 685980 - DNA, 25 bp, Rattus norvegicus
ttgtgtctcattgtgcagtgtggat

SEQ ID NO: 685981 - DNA, 25 bp, Rattus norvegicus
ttgtgtctcccacgctgggctgaag

SEQ ID NO: 685982 - DNA, 25 bp, Rattus norvegicus
ttgtgtctcccaggctgggctgaag

SEQ ID NO: 685983 - DNA, 25 bp, Rattus norvegicus
ttgtgtctcccgagaccaataagct

SEQ ID NO: 685984 - DNA, 25 bp, Rattus norvegicus
ttgtgtctcccgtgaccaataagct

SEQ ID NO: 685985 - DNA, 25 bp, Rattus norvegicus
ttgtgtctctatctcagcctgggaa

SEQ ID NO: 685986 - DNA, 25 bp, Rattus norvegicus
ttgtgtctctatgtcagcctgggaa

SEQ ID NO: 685987 - DNA, 25 bp, Rattus norvegicus
ttgtgtctctctatgcaccattggg

SEQ ID NO: 685988 - DNA, 25 bp, Rattus norvegicus
ttgtgtctctctcctcagtaatcac

SEQ ID NO: 685989 - DNA, 25 bp, Rattus norvegicus
ttgtgtctctctcgtcttccataaa

SEQ ID NO: 685990 - DNA, 25 bp, Rattus norvegicus
ttgtgtctctctgctcagtaatcac

SEQ ID NO: 685991 - DNA, 25 bp, Rattus norvegicus
ttgtgtctctctggtcttccataaa

SEQ ID NO: 685992 - DNA, 25 bp, Rattus norvegicus
ttgtgtctctctttgcaccattggg

SEQ ID NO: 685993 - DNA, 25 bp, Rattus norvegicus
ttgtgtctgagcaccgagcattaga

SEQ ID NO: 685994 - DNA, 25 bp, Rattus norvegicus
ttgtgtctgagctccgagcattaga

SEQ ID NO: 685995 - DNA, 25 bp, Rattus norvegicus
ttgtgtctgattccgtttgatttcc

SEQ ID NO: 685996 - DNA, 25 bp, Rattus norvegicus
ttgtgtctgattgcgtttgatttcc

SEQ ID NO: 685997 - DNA, 25 bp, Rattus norvegicus
ttgtgtctgcagagactgatcttcc

SEQ ID NO: 685998 - DNA, 25 bp, Rattus norvegicus
ttgtgtctgcagtgactgatcttcc

SEQ ID NO: 685999 - DNA, 25 bp, Rattus norvegicus
ttgtgtctgctgctatggactccaa

SEQ ID NO: 686000 - DNA, 25 bp, Rattus norvegicus
ttgtgtctgctggtatggactccaa

SEQ ID NO: 686001 - DNA, 25 bp, Rattus norvegicus
ttgtgtctggacagcattgtgaaca

SEQ ID NO: 686002 - DNA, 25 bp, Rattus norvegicus
ttgtgtctggactgcattgtgaaca

SEQ ID NO: 686003 - DNA, 25 bp, Rattus norvegicus
ttgtgtctgtatatatattcgtgta

SEQ ID NO: 686004 - DNA, 25 bp, Rattus norvegicus
ttgtgtctgtatttatattcgtgta

SEQ ID NO: 686005 - DNA, 25 bp, Rattus norvegicus
ttgtgtctgtctctgatacacggac

SEQ ID NO: 686006 - DNA, 25 bp, Rattus norvegicus
ttgtgtctgtctgtgatacacggac

SEQ ID NO: 686007 - DNA, 25 bp, Rattus norvegicus
ttgtgtctgtttaattatggctcca

SEQ ID NO: 686008 - DNA, 25 bp, Rattus norvegicus
ttgtgtctgtttccagtcacgtgac

SEQ ID NO: 686009 - DNA, 25 bp, Rattus norvegicus
ttgtgtctgtttgcagtcacgtgac

SEQ ID NO: 686010 - DNA, 25 bp, Rattus norvegicus
ttgtgtctgttttattatggctcca

SEQ ID NO: 686011 - DNA, 25 bp, Rattus norvegicus
ttgtgtcttagtaccagggttgggt

SEQ ID NO: 686012 - DNA, 25 bp, Rattus norvegicus
ttgtgtcttagttccagggttgggt

SEQ ID NO: 686013 - DNA, 25 bp, Rattus norvegicus
ttgtgtcttctcatcagactctgaa

SEQ ID NO: 686014 - DNA, 25 bp, Rattus norvegicus
ttgtgtcttctcttcagactctgaa

SEQ ID NO: 686015 - DNA, 25 bp, Rattus norvegicus
ttgtgtcttgcgctgtctccttgtc

SEQ ID NO: 686016 - DNA, 25 bp, Rattus norvegicus
ttgtgtcttgcggtgtctccttgtc

SEQ ID NO: 686017 - DNA, 25 bp, Rattus norvegicus
ttgtgtcttgtgaccaactgagttg

SEQ ID NO: 686018 - DNA, 25 bp, Rattus norvegicus
ttgtgtcttgtgcttctgtggctca

SEQ ID NO: 686019 - DNA, 25 bp, Rattus norvegicus
ttgtgtcttgtggttctgtggctca

SEQ ID NO: 686020 - DNA, 25 bp, Rattus norvegicus
ttgtgtcttgtgtccaactgagttg

SEQ ID NO: 686021 - DNA, 25 bp, Rattus norvegicus
ttgtgtgaaaacctgtccccattaa

SEQ ID NO: 686022 - DNA, 25 bp, Rattus norvegicus
ttgtgtgaaaacgtgtccccattaa

SEQ ID NO: 686023 - DNA, 25 bp, Rattus norvegicus
ttgtgtgaaacccacggagctccca

SEQ ID NO: 686024 - DNA, 25 bp, Rattus norvegicus
ttgtgtgaaaccgacggagctccca

SEQ ID NO: 686025 - DNA, 25 bp, Rattus norvegicus
ttgtgtgacaatcaaactctgcagt

SEQ ID NO: 686026 - DNA, 25 bp, Rattus norvegicus
ttgtgtgacaatgaaactctgcagt

SEQ ID NO: 686027 - DNA, 25 bp, Rattus norvegicus
ttgtgtgacagacgagtccggtcct

SEQ ID NO: 686028 - DNA, 25 bp, Rattus norvegicus
ttgtgtgacagaggagtccggtcct

SEQ ID NO: 686029 - DNA, 25 bp, Rattus norvegicus
ttgtgtgaccaacctctataacgct

SEQ ID NO: 686030 - DNA, 25 bp, Rattus norvegicus
ttgtgtgaccaagctctataacgct

SEQ ID NO: 686031 - DNA, 25 bp, Rattus norvegicus
ttgtgtgagactcactcctcctgaa

SEQ ID NO: 686032 - DNA, 25 bp, Rattus norvegicus
ttgtgtgagactgactcctcctgaa

SEQ ID NO: 686033 - DNA, 25 bp, Rattus norvegicus
ttgtgtgagcgtactccatggctgc

SEQ ID NO: 686034 - DNA, 25 bp, Rattus norvegicus
ttgtgtgagcgttctccatggctgc

SEQ ID NO: 686035 - DNA, 25 bp, Rattus norvegicus
ttgtgtgagctcattgacccttcat

SEQ ID NO: 686036 - DNA, 25 bp, Rattus norvegicus
ttgtgtgagctctttgacccttcat

SEQ ID NO: 686037 - DNA, 25 bp, Rattus norvegicus
ttgtgtgcaataaataccctgttca

SEQ ID NO: 686038 - DNA, 25 bp, Rattus norvegicus
ttgtgtgcaatatataccctgttca

SEQ ID NO: 686039 - DNA, 25 bp, Rattus norvegicus
ttgtgtgcacatccttccttgcttc

SEQ ID NO: 686040 - DNA, 25 bp, Rattus norvegicus
ttgtgtgcacatgcttccttgcttc

SEQ ID NO: 686041 - DNA, 25 bp, Rattus norvegicus
ttgtgtgcagaaagtgtcttccttc

SEQ ID NO: 686042 - DNA, 25 bp, Rattus norvegicus
ttgtgtgcagaatgtgtcttccttc

SEQ ID NO: 686043 - DNA, 25 bp, Rattus norvegicus
ttgtgtgcaggtctccaacagctct

SEQ ID NO: 686044 - DNA, 25 bp, Rattus norvegicus
ttgtgtgcaggtgtccaacagctct

SEQ ID NO: 686045 - DNA, 25 bp, Rattus norvegicus
ttgtgtgcagttcccaactttctgc

SEQ ID NO: 686046 - DNA, 25 bp, Rattus norvegicus
ttgtgtgcagttgccaactttctgc

SEQ ID NO: 686047 - DNA, 25 bp, Rattus norvegicus
ttgtgtgccaggctaaaagacctac

SEQ ID NO: 686048 - DNA, 25 bp, Rattus norvegicus
ttgtgtgccagggtaaaagacctac

SEQ ID NO: 686049 - DNA, 25 bp, Rattus norvegicus
ttgtgtgccgttcagtcacccagat

SEQ ID NO: 686050 - DNA, 25 bp, Rattus norvegicus
ttgtgtgccgttgagtcacccagat

SEQ ID NO: 686051 - DNA, 25 bp, Rattus norvegicus
ttgtgtgcctacatctgaggccgaa

SEQ ID NO: 686052 - DNA, 25 bp, Rattus norvegicus
ttgtgtgcctacttctgaggccgaa

SEQ ID NO: 686053 - DNA, 25 bp, Rattus norvegicus
ttgtgtgccttaatcctggagacta

SEQ ID NO: 686054 - DNA, 25 bp, Rattus norvegicus
ttgtgtgccttattcctggagacta

SEQ ID NO: 686055 - DNA, 25 bp, Rattus norvegicus
ttgtgtgcgcacatttgcaggtcgc

SEQ ID NO: 686056 - DNA, 25 bp, Rattus norvegicus
ttgtgtgcgcacttttgcaggtcgc

SEQ ID NO: 686057 - DNA, 25 bp, Rattus norvegicus
ttgtgtgctccgatttccatagaag

SEQ ID NO: 686058 - DNA, 25 bp, Rattus norvegicus
ttgtgtgctccgttttccatagaag

SEQ ID NO: 686059 - DNA, 25 bp, Rattus norvegicus
ttgtgtgctgcacggagccttgaat

SEQ ID NO: 686060 - DNA, 25 bp, Rattus norvegicus
ttgtgtgctgcagggagccttgaat

SEQ ID NO: 686061 - DNA, 25 bp, Rattus norvegicus
ttgtgtgctgttcctgttcagtatt

SEQ ID NO: 686062 - DNA, 25 bp, Rattus norvegicus
ttgtgtgctgttgctgttcagtatt

SEQ ID NO: 686063 - DNA, 25 bp, Rattus norvegicus
ttgtgtggactcaactttattaagc

SEQ ID NO: 686064 - DNA, 25 bp, Rattus norvegicus
ttgtgtggactctactttattaagc

SEQ ID NO: 686065 - DNA, 25 bp, Rattus norvegicus
ttgtgtggcataaagattactctgt

SEQ ID NO: 686066 - DNA, 25 bp, Rattus norvegicus
ttgtgtggcatatagattactctgt

SEQ ID NO: 686067 - DNA, 25 bp, Rattus norvegicus
ttgtgtggccttagattttttgcat

SEQ ID NO: 686068 - DNA, 25 bp, Rattus norvegicus
ttgtgtggcctttgattttttgcat

SEQ ID NO: 686069 - DNA, 25 bp, Rattus norvegicus
ttgtgtgggctacaagtgcttgtac

SEQ ID NO: 686070 - DNA, 25 bp, Rattus norvegicus
ttgtgtgggctagaagtgcttgtac

SEQ ID NO: 686071 - DNA, 25 bp, Rattus norvegicus
ttgtgtgggttcctcaaagacggac

SEQ ID NO: 686072 - DNA, 25 bp, Rattus norvegicus
ttgtgtgggttcgtcaaagacggac

SEQ ID NO: 686073 - DNA, 25 bp, Rattus norvegicus
ttgtgtggtatgctggcaaagccct

SEQ ID NO: 686074 - DNA, 25 bp, Rattus norvegicus
ttgtgtggtatggtggcaaagccct

SEQ ID NO: 686075 - DNA, 25 bp, Rattus norvegicus
ttgtgtggttcaacaggccattcct

SEQ ID NO: 686076 - DNA, 25 bp, Rattus norvegicus
ttgtgtggttcatcaggccattcct

SEQ ID NO: 686077 - DNA, 25 bp, Rattus norvegicus
ttgtgtggttccaattaactccctg

SEQ ID NO: 686078 - DNA, 25 bp, Rattus norvegicus
ttgtgtggttcctattaactccctg

SEQ ID NO: 686079 - DNA, 25 bp, Rattus norvegicus
ttgtgtggtttccttttaaagacag

SEQ ID NO: 686080 - DNA, 25 bp, Rattus norvegicus
ttgtgtggtttcgttttaaagacag

SEQ ID NO: 686081 - DNA, 25 bp, Rattus norvegicus
ttgtgtgtacatattcggaggccct

SEQ ID NO: 686082 - DNA, 25 bp, Rattus norvegicus
ttgtgtgtacattttcggaggccct

SEQ ID NO: 686083 - DNA, 25 bp, Rattus norvegicus
ttgtgtgtatgtcttggctgtgcct

SEQ ID NO: 686084 - DNA, 25 bp, Rattus norvegicus
ttgtgtgtatgtgttggctgtgcct

SEQ ID NO: 686085 - DNA, 25 bp, Rattus norvegicus
ttgtgtgtatttaccagctctggtc

SEQ ID NO: 686086 - DNA, 25 bp, Rattus norvegicus
ttgtgtgtattttccagctctggtc

SEQ ID NO: 686087 - DNA, 25 bp, Rattus norvegicus
ttgtgtgtcaacatgtcacagcatg

SEQ ID NO: 686088 - DNA, 25 bp, Rattus norvegicus
ttgtgtgtcaacttgtcacagcatg

SEQ ID NO: 686089 - DNA, 25 bp, Rattus norvegicus
ttgtgtgtccctaccatacagggct

SEQ ID NO: 686090 - DNA, 25 bp, Rattus norvegicus
ttgtgtgtccctcacttgaggcaag

SEQ ID NO: 686091 - DNA, 25 bp, Rattus norvegicus
ttgtgtgtccctgacttgaggcaag

SEQ ID NO: 686092 - DNA, 25 bp, Rattus norvegicus
ttgtgtgtcccttccatacagggct

SEQ ID NO: 686093 - DNA, 25 bp, Rattus norvegicus
ttgtgtgtcctaaaccaacctgcaa

SEQ ID NO: 686094 - DNA, 25 bp, Rattus norvegicus
ttgtgtgtcctataccaacctgcaa

SEQ ID NO: 686095 - DNA, 25 bp, Rattus norvegicus
ttgtgtgtccttattgtcactactc

SEQ ID NO: 686096 - DNA, 25 bp, Rattus norvegicus
ttgtgtgtcctttttgtcactactc

SEQ ID NO: 686097 - DNA, 25 bp, Rattus norvegicus
ttgtgtgtctctcatctcatgcact

SEQ ID NO: 686098 - DNA, 25 bp, Rattus norvegicus
ttgtgtgtctctgatctcatgcact

SEQ ID NO: 686099 - DNA, 25 bp, Rattus norvegicus
ttgtgtgtgccaacaagggccctga

SEQ ID NO: 686100 - DNA, 25 bp, Rattus norvegicus
ttgtgtgtgccatcaagggccctga

SEQ ID NO: 686101 - DNA, 25 bp, Rattus norvegicus
ttgtgtgtgcttaaaacccgggcca

SEQ ID NO: 686102 - DNA, 25 bp, Rattus norvegicus
ttgtgtgtgctttaaacccgggcca

SEQ ID NO: 686103 - DNA, 25 bp, Rattus norvegicus
ttgtgtgtggcccttgacatacatg

SEQ ID NO: 686104 - DNA, 25 bp, Rattus norvegicus
ttgtgtgtggccgttgacatacatg

SEQ ID NO: 686105 - DNA, 25 bp, Rattus norvegicus
ttgtgtgtgtctcaggcacgcctag

SEQ ID NO: 686106 - DNA, 25 bp, Rattus norvegicus
ttgtgtgtgtctgaggcacgcctag

SEQ ID NO: 686107 - DNA, 25 bp, Rattus norvegicus
ttgtgtgtgtgtctcactctggcca

SEQ ID NO: 686108 - DNA, 25 bp, Rattus norvegicus
ttgtgtgtgtgtgtcactctggcca

SEQ ID NO: 686109 - DNA, 25 bp, Rattus norvegicus
ttgtgtgttctcagctttggctgca

SEQ ID NO: 686110 - DNA, 25 bp, Rattus norvegicus
ttgtgtgttctctgctttggctgca

SEQ ID NO: 686111 - DNA, 25 bp, Rattus norvegicus
ttgtgtgttgatacacttggccgat

SEQ ID NO: 686112 - DNA, 25 bp, Rattus norvegicus
ttgtgtgttgattcacttggccgat

SEQ ID NO: 686113 - DNA, 25 bp, Rattus norvegicus
ttgtgtgttgtaaatttgcgtcctt

SEQ ID NO: 686114 - DNA, 25 bp, Rattus norvegicus
ttgtgtgttgtacctcatttgtttc

SEQ ID NO: 686115 - DNA, 25 bp, Rattus norvegicus
ttgtgtgttgtagctcatttgtttc

SEQ ID NO: 686116 - DNA, 25 bp, Rattus norvegicus
ttgtgtgttgtatatttgcgtcctt

SEQ ID NO: 686117 - DNA, 25 bp, Rattus norvegicus
ttgtgtgtttccactagcgatgggt

SEQ ID NO: 686118 - DNA, 25 bp, Rattus norvegicus
ttgtgtgtttcctctagcgatgggt

SEQ ID NO: 686119 - DNA, 25 bp, Rattus norvegicus
ttgtgttacctgacttctgaagcgg

SEQ ID NO: 686120 - DNA, 25 bp, Rattus norvegicus
ttgtgttacctgcagaattcttccc

SEQ ID NO: 686121 - DNA, 25 bp, Rattus norvegicus
ttgtgttacctggagaattcttccc

SEQ ID NO: 686122 - DNA, 25 bp, Rattus norvegicus
ttgtgttacctgtcttctgaagcgg

SEQ ID NO: 686123 - DNA, 25 bp, Rattus norvegicus
ttgtgttactttcgccagtcgctag

SEQ ID NO: 686124 - DNA, 25 bp, Rattus norvegicus
ttgtgttactttggccagtcgctag

SEQ ID NO: 686125 - DNA, 25 bp, Rattus norvegicus
ttgtgttagctcatctaggctctgc

SEQ ID NO: 686126 - DNA, 25 bp, Rattus norvegicus
ttgtgttagctcttctaggctctgc

SEQ ID NO: 686127 - DNA, 25 bp, Rattus norvegicus
ttgtgttatgcccatccagcgagaa

SEQ ID NO: 686128 - DNA, 25 bp, Rattus norvegicus
ttgtgttatgccgatccagcgagaa

SEQ ID NO: 686129 - DNA, 25 bp, Rattus norvegicus
ttgtgttatgtgaccatggcctctc

SEQ ID NO: 686130 - DNA, 25 bp, Rattus norvegicus
ttgtgttatgtgtccatggcctctc

SEQ ID NO: 686131 - DNA, 25 bp, Rattus norvegicus
ttgtgttattccatcagcaaatatt

SEQ ID NO: 686132 - DNA, 25 bp, Rattus norvegicus
ttgtgttattccttcagcaaatatt

SEQ ID NO: 686133 - DNA, 25 bp, Rattus norvegicus
ttgtgttattttaccccatgtaaag

SEQ ID NO: 686134 - DNA, 25 bp, Rattus norvegicus
ttgtgttatttttccccatgtaaag

SEQ ID NO: 686135 - DNA, 25 bp, Rattus norvegicus
ttgtgttcacacatcagcaccaggg

SEQ ID NO: 686136 - DNA, 25 bp, Rattus norvegicus
ttgtgttcacacttcagcaccaggg

SEQ ID NO: 686137 - DNA, 25 bp, Rattus norvegicus
ttgtgttcactacatccccttcaga

SEQ ID NO: 686138 - DNA, 25 bp, Rattus norvegicus
ttgtgttcactagatccccttcaga

SEQ ID NO: 686139 - DNA, 25 bp, Rattus norvegicus
ttgtgttcagtgatcaaggcatgac

SEQ ID NO: 686140 - DNA, 25 bp, Rattus norvegicus
ttgtgttcagtgttcaaggcatgac

SEQ ID NO: 686141 - DNA, 25 bp, Rattus norvegicus
ttgtgttccaacaggcagactcgat

SEQ ID NO: 686142 - DNA, 25 bp, Rattus norvegicus
ttgtgttccaactggcagactcgat

SEQ ID NO: 686143 - DNA, 25 bp, Rattus norvegicus
ttgtgttcccaactggtggttttat

SEQ ID NO: 686144 - DNA, 25 bp, Rattus norvegicus
ttgtgttcccaagtggtggttttat

SEQ ID NO: 686145 - DNA, 25 bp, Rattus norvegicus
ttgtgttcccagagcgtgctgataa

SEQ ID NO: 686146 - DNA, 25 bp, Rattus norvegicus
ttgtgttcccagtgcgtgctgataa

SEQ ID NO: 686147 - DNA, 25 bp, Rattus norvegicus
ttgtgttcccgacgctaccgatgtg

SEQ ID NO: 686148 - DNA, 25 bp, Rattus norvegicus
ttgtgttcccgaggctaccgatgtg

SEQ ID NO: 686149 - DNA, 25 bp, Rattus norvegicus
ttgtgttcctcacccatgctcgcag

SEQ ID NO: 686150 - DNA, 25 bp, Rattus norvegicus
ttgtgttcctcagccatgctcgcag

SEQ ID NO: 686151 - DNA, 25 bp, Rattus norvegicus
ttgtgttcctctccatgtgttcaga

SEQ ID NO: 686152 - DNA, 25 bp, Rattus norvegicus
ttgtgttcctctgcatgtgttcaga

SEQ ID NO: 686153 - DNA, 25 bp, Rattus norvegicus
ttgtgttcctgaccactttgcaaga

SEQ ID NO: 686154 - DNA, 25 bp, Rattus norvegicus
ttgtgttcctgagcactttgcaaga

SEQ ID NO: 686155 - DNA, 25 bp, Rattus norvegicus
ttgtgttctcttccccttttaacaa

SEQ ID NO: 686156 - DNA, 25 bp, Rattus norvegicus
ttgtgttctcttgcccttttaacaa

SEQ ID NO: 686157 - DNA, 25 bp, Rattus norvegicus
ttgtgttctgatactgagccccttg

SEQ ID NO: 686158 - DNA, 25 bp, Rattus norvegicus
ttgtgttctgattctgagccccttg

SEQ ID NO: 686159 - DNA, 25 bp, Rattus norvegicus
ttgtgttctgccattgaagttgctt

SEQ ID NO: 686160 - DNA, 25 bp, Rattus norvegicus
ttgtgttctgcctttgaagttgctt

SEQ ID NO: 686161 - DNA, 25 bp, Rattus norvegicus
ttgtgttctgtgatggaagcgtcca

SEQ ID NO: 686162 - DNA, 25 bp, Rattus norvegicus
ttgtgttctgtgttggaagcgtcca

SEQ ID NO: 686163 - DNA, 25 bp, Rattus norvegicus
ttgtgttcttccagcgtcttacgag

SEQ ID NO: 686164 - DNA, 25 bp, Rattus norvegicus
ttgtgttcttcctgcgtcttacgag

SEQ ID NO: 686165 - DNA, 25 bp, Rattus norvegicus
ttgtgttgaaccatattccctgcta

SEQ ID NO: 686166 - DNA, 25 bp, Rattus norvegicus
ttgtgttgaacccagcgatgaccat

SEQ ID NO: 686167 - DNA, 25 bp, Rattus norvegicus
ttgtgttgaaccgagcgatgaccat

SEQ ID NO: 686168 - DNA, 25 bp, Rattus norvegicus
ttgtgttgaaccttattccctgcta

SEQ ID NO: 686169 - DNA, 25 bp, Rattus norvegicus
ttgtgttgaagccaagtgcagttgt

SEQ ID NO: 686170 - DNA, 25 bp, Rattus norvegicus
ttgtgttgaagcctatgtctcccat

SEQ ID NO: 686171 - DNA, 25 bp, Rattus norvegicus
ttgtgttgaagcgaagtgcagttgt

SEQ ID NO: 686172 - DNA, 25 bp, Rattus norvegicus
ttgtgttgaagcgtatgtctcccat

SEQ ID NO: 686173 - DNA, 25 bp, Rattus norvegicus
ttgtgttgacgtctgttgtttccat

SEQ ID NO: 686174 - DNA, 25 bp, Rattus norvegicus
ttgtgttgacgtgtgttgtttccat

SEQ ID NO: 686175 - DNA, 25 bp, Rattus norvegicus
ttgtgttgattcacctatcctaggc

SEQ ID NO: 686176 - DNA, 25 bp, Rattus norvegicus
ttgtgttgattctcctatcctaggc

SEQ ID NO: 686177 - DNA, 25 bp, Rattus norvegicus
ttgtgttgcaggctagctccatgag

SEQ ID NO: 686178 - DNA, 25 bp, Rattus norvegicus
ttgtgttgcagggtagctccatgag

SEQ ID NO: 686179 - DNA, 25 bp, Rattus norvegicus
ttgtgttgctgcatgcgcccctgaa

SEQ ID NO: 686180 - DNA, 25 bp, Rattus norvegicus
ttgtgttgctgcttgcgcccctgaa

SEQ ID NO: 686181 - DNA, 25 bp, Rattus norvegicus
ttgtgttgctgtcaccatctcctat

SEQ ID NO: 686182 - DNA, 25 bp, Rattus norvegicus
ttgtgttgctgtgaccatctcctat

SEQ ID NO: 686183 - DNA, 25 bp, Rattus norvegicus
ttgtgttggtctacattcctgccta

SEQ ID NO: 686184 - DNA, 25 bp, Rattus norvegicus
ttgtgttggtcttcattcctgccta

SEQ ID NO: 686185 - DNA, 25 bp, Rattus norvegicus
ttgtgttgtccacctcatctgaaca

SEQ ID NO: 686186 - DNA, 25 bp, Rattus norvegicus
ttgtgttgtccagctcatctgaaca

SEQ ID NO: 686187 - DNA, 25 bp, Rattus norvegicus
ttgtgttgtgctaagttaccatcca

SEQ ID NO: 686188 - DNA, 25 bp, Rattus norvegicus
ttgtgttgtgcttagttaccatcca

SEQ ID NO: 686189 - DNA, 25 bp, Rattus norvegicus
ttgtgttgtgtgcactctactttat

SEQ ID NO: 686190 - DNA, 25 bp, Rattus norvegicus
ttgtgttgtgtggactctactttat

SEQ ID NO: 686191 - DNA, 25 bp, Rattus norvegicus
ttgtgttgttttctcgtatctggcc

SEQ ID NO: 686192 - DNA, 25 bp, Rattus norvegicus
ttgtgttgttttgtcgtatctggcc

SEQ ID NO: 686193 - DNA, 25 bp, Rattus norvegicus
ttgtgtttaaccatcttgtatgtaa

SEQ ID NO: 686194 - DNA, 25 bp, Rattus norvegicus
ttgtgtttaaccttcttgtatgtaa

SEQ ID NO: 686195 - DNA, 25 bp, Rattus norvegicus
ttgtgtttaccactgggtcttccac

SEQ ID NO: 686196 - DNA, 25 bp, Rattus norvegicus
ttgtgtttaccagtgggtcttccac

SEQ ID NO: 686197 - DNA, 25 bp, Rattus norvegicus
ttgtgtttactaatgttgactagga

SEQ ID NO: 686198 - DNA, 25 bp, Rattus norvegicus
ttgtgtttactattgttgactagga

SEQ ID NO: 686199 - DNA, 25 bp, Rattus norvegicus
ttgtgtttactgaccattacattaa

SEQ ID NO: 686200 - DNA, 25 bp, Rattus norvegicus
ttgtgtttactgtccattacattaa

SEQ ID NO: 686201 - DNA, 25 bp, Rattus norvegicus
ttgtgtttagtgattgcccttcctc

SEQ ID NO: 686202 - DNA, 25 bp, Rattus norvegicus
ttgtgtttagtgtttgcccttcctc

SEQ ID NO: 686203 - DNA, 25 bp, Rattus norvegicus
ttgtgtttatctagttggttcccat

SEQ ID NO: 686204 - DNA, 25 bp, Rattus norvegicus
ttgtgtttatcttgttggttcccat

SEQ ID NO: 686205 - DNA, 25 bp, Rattus norvegicus
ttgtgtttatgcctaacgccagcca

SEQ ID NO: 686206 - DNA, 25 bp, Rattus norvegicus
ttgtgtttatgcgtaacgccagcca

SEQ ID NO: 686207 - DNA, 25 bp, Rattus norvegicus
ttgtgtttatttcttatccctgggt

SEQ ID NO: 686208 - DNA, 25 bp, Rattus norvegicus
ttgtgtttatttgttatccctgggt

SEQ ID NO: 686209 - DNA, 25 bp, Rattus norvegicus
ttgtgtttcaggctgatgcgccaaa

SEQ ID NO: 686210 - DNA, 25 bp, Rattus norvegicus
ttgtgtttcagggtgatgcgccaaa

SEQ ID NO: 686211 - DNA, 25 bp, Rattus norvegicus
ttgtgtttcatcacctgcgcgcgcg

SEQ ID NO: 686212 - DNA, 25 bp, Rattus norvegicus
ttgtgtttcatctcctgcgcgcgcg

SEQ ID NO: 686213 - DNA, 25 bp, Rattus norvegicus
ttgtgtttctgaacatgtggtgccc

SEQ ID NO: 686214 - DNA, 25 bp, Rattus norvegicus
ttgtgtttctgatcatgtggtgccc

SEQ ID NO: 686215 - DNA, 25 bp, Rattus norvegicus
ttgtgtttctgccagagcgactctc

SEQ ID NO: 686216 - DNA, 25 bp, Rattus norvegicus
ttgtgtttctgcgagagcgactctc

SEQ ID NO: 686217 - DNA, 25 bp, Rattus norvegicus
ttgtgtttctgtaagccccaggaac

SEQ ID NO: 686218 - DNA, 25 bp, Rattus norvegicus
ttgtgtttctgttagccccaggaac

SEQ ID NO: 686219 - DNA, 25 bp, Rattus norvegicus
ttgtgtttcttgcagccacttggaa

SEQ ID NO: 686220 - DNA, 25 bp, Rattus norvegicus
ttgtgtttcttggagccacttggaa

SEQ ID NO: 686221 - DNA, 25 bp, Rattus norvegicus
ttgtgtttctttccttctcatgttt

SEQ ID NO: 686222 - DNA, 25 bp, Rattus norvegicus
ttgtgtttctttgcttctcatgttt

SEQ ID NO: 686223 - DNA, 25 bp, Rattus norvegicus
ttgtgtttgtctcctaatctgtaat

SEQ ID NO: 686224 - DNA, 25 bp, Rattus norvegicus
ttgtgtttgtctgctaatctgtaat

SEQ ID NO: 686225 - DNA, 25 bp, Rattus norvegicus
ttgtgtttgttaaaggccgtgtcca

SEQ ID NO: 686226 - DNA, 25 bp, Rattus norvegicus
ttgtgtttgttataggccgtgtcca

SEQ ID NO: 686227 - DNA, 25 bp, Rattus norvegicus
ttgtgttttatccttgctcccaggg

SEQ ID NO: 686228 - DNA, 25 bp, Rattus norvegicus
ttgtgttttatcgttgctcccaggg

SEQ ID NO: 686229 - DNA, 25 bp, Rattus norvegicus
ttgtgttttcatatggccacctgaa

SEQ ID NO: 686230 - DNA, 25 bp, Rattus norvegicus
ttgtgttttcatttggccacctgaa

SEQ ID NO: 686231 - DNA, 25 bp, Rattus norvegicus
ttgtgttttccaaacctatctgagg

SEQ ID NO: 686232 - DNA, 25 bp, Rattus norvegicus
ttgtgttttccatacctatctgagg

SEQ ID NO: 686233 - DNA, 25 bp, Rattus norvegicus
ttgtgttttcttccaaatgtcttta

SEQ ID NO: 686234 - DNA, 25 bp, Rattus norvegicus
ttgtgttttcttgcaaatgtcttta

SEQ ID NO: 686235 - DNA, 25 bp, Rattus norvegicus
ttgtgttttggtactaggctccgcc

SEQ ID NO: 686236 - DNA, 25 bp, Rattus norvegicus
ttgtgttttggttctaggctccgcc

SEQ ID NO: 686237 - DNA, 25 bp, Rattus norvegicus
ttgtgtttttatatgcatctgctaa

SEQ ID NO: 686238 - DNA, 25 bp, Rattus norvegicus
ttgtgtttttatttgcatctgctaa

SEQ ID NO: 686239 - DNA, 25 bp, Rattus norvegicus
ttgttaaatctgctacacctcccaa

SEQ ID NO: 686240 - DNA, 25 bp, Rattus norvegicus
ttgttaaatctggtacacctcccaa

SEQ ID NO: 686241 - DNA, 25 bp, Rattus norvegicus
ttgttaacatcgactctcttccata

SEQ ID NO: 686242 - DNA, 25 bp, Rattus norvegicus
ttgttaacatcgtctctcttccata

SEQ ID NO: 686243 - DNA, 25 bp, Rattus norvegicus
ttgttaacccagctgcctcgctaag

SEQ ID NO: 686244 - DNA, 25 bp, Rattus norvegicus
ttgttaacccaggtgcctcgctaag

SEQ ID NO: 686245 - DNA, 25 bp, Rattus norvegicus
ttgttaacctacctgttgctgcaat

SEQ ID NO: 686246 - DNA, 25 bp, Rattus norvegicus
ttgttaacctacgtgttgctgcaat

SEQ ID NO: 686247 - DNA, 25 bp, Rattus norvegicus
ttgttaactaggaccttcgagatcc

SEQ ID NO: 686248 - DNA, 25 bp, Rattus norvegicus
ttgttaactaggtccttcgagatcc

SEQ ID NO: 686249 - DNA, 25 bp, Rattus norvegicus
ttgttaactcttctacatatcatta

SEQ ID NO: 686250 - DNA, 25 bp, Rattus norvegicus
ttgttaactcttgtacatatcatta

SEQ ID NO: 686251 - DNA, 25 bp, Rattus norvegicus
ttgttaactgcaattctggccttgt

SEQ ID NO: 686252 - DNA, 25 bp, Rattus norvegicus
ttgttaactgcatttctggccttgt

SEQ ID NO: 686253 - DNA, 25 bp, Rattus norvegicus
ttgttaagcacaatggccagcccca

SEQ ID NO: 686254 - DNA, 25 bp, Rattus norvegicus
ttgttaagcacattggccagcccca

SEQ ID NO: 686255 - DNA, 25 bp, Rattus norvegicus
ttgttaagccatattgccaactccc

SEQ ID NO: 686256 - DNA, 25 bp, Rattus norvegicus
ttgttaagccatcgctgaccttagt

SEQ ID NO: 686257 - DNA, 25 bp, Rattus norvegicus
ttgttaagccatggctgaccttagt

SEQ ID NO: 686258 - DNA, 25 bp, Rattus norvegicus
ttgttaagccattttgccaactccc

SEQ ID NO: 686259 - DNA, 25 bp, Rattus norvegicus
ttgttaagccttacccttgttcttg

SEQ ID NO: 686260 - DNA, 25 bp, Rattus norvegicus
ttgttaagcctttcccttgttcttg

SEQ ID NO: 686261 - DNA, 25 bp, Rattus norvegicus
ttgttaagttgtccacctcggtcaa

SEQ ID NO: 686262 - DNA, 25 bp, Rattus norvegicus
ttgttaagttgtgcacctcggtcaa

SEQ ID NO: 686263 - DNA, 25 bp, Rattus norvegicus
ttgttaatatttagctgcccttggg

SEQ ID NO: 686264 - DNA, 25 bp, Rattus norvegicus
ttgttaatattttgctgcccttggg

SEQ ID NO: 686265 - DNA, 25 bp, Rattus norvegicus
ttgttaatgcaacggctttacggtg

SEQ ID NO: 686266 - DNA, 25 bp, Rattus norvegicus
ttgttaatgcaagggctttacggtg

SEQ ID NO: 686267 - DNA, 25 bp, Rattus norvegicus
ttgttaatggtgaggcttcgctata

SEQ ID NO: 686268 - DNA, 25 bp, Rattus norvegicus
ttgttaatggtgtggcttcgctata

SEQ ID NO: 686269 - DNA, 25 bp, Rattus norvegicus
ttgttacaacctaaacctcgtacag

SEQ ID NO: 686270 - DNA, 25 bp, Rattus norvegicus
ttgttacaaccttaacctcgtacag

SEQ ID NO: 686271 - DNA, 25 bp, Rattus norvegicus
ttgttacactgtagcaatcgcctat

SEQ ID NO: 686272 - DNA, 25 bp, Rattus norvegicus
ttgttacactgttgcaatcgcctat

SEQ ID NO: 686273 - DNA, 25 bp, Rattus norvegicus
ttgttacatttccacacacctgcat

SEQ ID NO: 686274 - DNA, 25 bp, Rattus norvegicus
ttgttacatttcgacacacctgcat

SEQ ID NO: 686275 - DNA, 25 bp, Rattus norvegicus
ttgttaccagtgacaacgccctcgt

SEQ ID NO: 686276 - DNA, 25 bp, Rattus norvegicus
ttgttaccagtgtcaacgccctcgt

SEQ ID NO: 686277 - DNA, 25 bp, Rattus norvegicus
ttgttaccccaacgtcctagaagat

SEQ ID NO: 686278 - DNA, 25 bp, Rattus norvegicus
ttgttaccccaaggtcctagaagat

SEQ ID NO: 686279 - DNA, 25 bp, Rattus norvegicus
ttgttaccgcccaggaaaggtgcta

SEQ ID NO: 686280 - DNA, 25 bp, Rattus norvegicus
ttgttaccgccctggaaaggtgcta

SEQ ID NO: 686281 - DNA, 25 bp, Rattus norvegicus
ttgttaccgtcccatggtccgggag

SEQ ID NO: 686282 - DNA, 25 bp, Rattus norvegicus
ttgttaccgtccgatggtccgggag

SEQ ID NO: 686283 - DNA, 25 bp, Rattus norvegicus
ttgttacctcagattactccccaag

SEQ ID NO: 686284 - DNA, 25 bp, Rattus norvegicus
ttgttacctcagtttactccccaag

SEQ ID NO: 686285 - DNA, 25 bp, Rattus norvegicus
ttgttacctctacccagatacccat

SEQ ID NO: 686286 - DNA, 25 bp, Rattus norvegicus
ttgttacctctagccagatacccat

SEQ ID NO: 686287 - DNA, 25 bp, Rattus norvegicus
ttgttacggagaaaaagtggtggtc

SEQ ID NO: 686288 - DNA, 25 bp, Rattus norvegicus
ttgttacggagataaagtggtggtc

SEQ ID NO: 686289 - DNA, 25 bp, Rattus norvegicus
ttgttacgtgagacagtggtaccca

SEQ ID NO: 686290 - DNA, 25 bp, Rattus norvegicus
ttgttacgtgagtcagtggtaccca

SEQ ID NO: 686291 - DNA, 25 bp, Rattus norvegicus
ttgttactcgccagcccaataataa

SEQ ID NO: 686292 - DNA, 25 bp, Rattus norvegicus
ttgttactcgcctgcccaataataa

SEQ ID NO: 686293 - DNA, 25 bp, Rattus norvegicus
ttgttactctttcctgttttcttct

SEQ ID NO: 686294 - DNA, 25 bp, Rattus norvegicus
ttgttactctttgctgttttcttct

SEQ ID NO: 686295 - DNA, 25 bp, Rattus norvegicus
ttgttactgaataggcaggcacctt

SEQ ID NO: 686296 - DNA, 25 bp, Rattus norvegicus
ttgttactgaattggcaggcacctt

SEQ ID NO: 686297 - DNA, 25 bp, Rattus norvegicus
ttgttactgcgacctaccttactgt

SEQ ID NO: 686298 - DNA, 25 bp, Rattus norvegicus
ttgttactgcgagctaccttactgt

SEQ ID NO: 686299 - DNA, 25 bp, Rattus norvegicus
ttgttacttcacactggaaatttga

SEQ ID NO: 686300 - DNA, 25 bp, Rattus norvegicus
ttgttacttcactctggaaatttga

SEQ ID NO: 686301 - DNA, 25 bp, Rattus norvegicus
ttgttagacatcctggagacttgcc

SEQ ID NO: 686302 - DNA, 25 bp, Rattus norvegicus
ttgttagacatcgtggagacttgcc

SEQ ID NO: 686303 - DNA, 25 bp, Rattus norvegicus
ttgttagcccatattccttctttcg

SEQ ID NO: 686304 - DNA, 25 bp, Rattus norvegicus
ttgttagcccattttccttctttcg

SEQ ID NO: 686305 - DNA, 25 bp, Rattus norvegicus
ttgttagcccggcattgtcaggcca

SEQ ID NO: 686306 - DNA, 25 bp, Rattus norvegicus
ttgttagcccgggattgtcaggcca

SEQ ID NO: 686307 - DNA, 25 bp, Rattus norvegicus
ttgttagctgtcattctcatggtct

SEQ ID NO: 686308 - DNA, 25 bp, Rattus norvegicus
ttgttagctgtctttctcatggtct

SEQ ID NO: 686309 - DNA, 25 bp, Rattus norvegicus
ttgttagggtcacccttcagcatgt

SEQ ID NO: 686310 - DNA, 25 bp, Rattus norvegicus
ttgttagggtcagccttcagcatgt

SEQ ID NO: 686311 - DNA, 25 bp, Rattus norvegicus
ttgttagtaaatcccacaagcttcc

SEQ ID NO: 686312 - DNA, 25 bp, Rattus norvegicus
ttgttagtaaatgccacaagcttcc

SEQ ID NO: 686313 - DNA, 25 bp, Rattus norvegicus
ttgttagtctctctgcataccaaac

SEQ ID NO: 686314 - DNA, 25 bp, Rattus norvegicus
ttgttagtctctgtgcataccaaac

SEQ ID NO: 686315 - DNA, 25 bp, Rattus norvegicus
ttgttagtgactatgatgcctttta

SEQ ID NO: 686316 - DNA, 25 bp, Rattus norvegicus
ttgttagtgactttgatgcctttta

SEQ ID NO: 686317 - DNA, 25 bp, Rattus norvegicus
ttgttagtgcttactgtgttccttt

SEQ ID NO: 686318 - DNA, 25 bp, Rattus norvegicus
ttgttagtgctttctgtgttccttt

SEQ ID NO: 686319 - DNA, 25 bp, Rattus norvegicus
ttgttagttcctagtctccctgaag

SEQ ID NO: 686320 - DNA, 25 bp, Rattus norvegicus
ttgttagttccttgtctccctgaag

SEQ ID NO: 686321 - DNA, 25 bp, Rattus norvegicus
ttgttagttcttaggcaattcccct

SEQ ID NO: 686322 - DNA, 25 bp, Rattus norvegicus
ttgttagttctttggcaattcccct

SEQ ID NO: 686323 - DNA, 25 bp, Rattus norvegicus
ttgttatcagctcaagcgctccggt

SEQ ID NO: 686324 - DNA, 25 bp, Rattus norvegicus
ttgttatcagctgaagcgctccggt

SEQ ID NO: 686325 - DNA, 25 bp, Rattus norvegicus
ttgttatcagtaccattccaacctc

SEQ ID NO: 686326 - DNA, 25 bp, Rattus norvegicus
ttgttatcagtagcattccaacctc

SEQ ID NO: 686327 - DNA, 25 bp, Rattus norvegicus
ttgttatcattcctaaagcggtaat

SEQ ID NO: 686328 - DNA, 25 bp, Rattus norvegicus
ttgttatcattcgtaaagcggtaat

SEQ ID NO: 686329 - DNA, 25 bp, Rattus norvegicus
ttgttatctacacgagcctagaccc

SEQ ID NO: 686330 - DNA, 25 bp, Rattus norvegicus
ttgttatctacaggagcctagaccc

SEQ ID NO: 686331 - DNA, 25 bp, Rattus norvegicus
ttgttatctccacaaagctgcctgt

SEQ ID NO: 686332 - DNA, 25 bp, Rattus norvegicus
ttgttatctccagaaagctgcctgt

SEQ ID NO: 686333 - DNA, 25 bp, Rattus norvegicus
ttgttatgaggtatggcccttttgg

SEQ ID NO: 686334 - DNA, 25 bp, Rattus norvegicus
ttgttatgaggtttggcccttttgg

SEQ ID NO: 686335 - DNA, 25 bp, Rattus norvegicus
ttgttatgagttcctcatgctggca

SEQ ID NO: 686336 - DNA, 25 bp, Rattus norvegicus
ttgttatgagttgctcatgctggca

SEQ ID NO: 686337 - DNA, 25 bp, Rattus norvegicus
ttgttattcagccactttcacgatg

SEQ ID NO: 686338 - DNA, 25 bp, Rattus norvegicus
ttgttattcagcgactttcacgatg

SEQ ID NO: 686339 - DNA, 25 bp, Rattus norvegicus
ttgttattgtcacaccaagcttgta

SEQ ID NO: 686340 - DNA, 25 bp, Rattus norvegicus
ttgttattgtcagaccaagcttgta

SEQ ID NO: 686341 - DNA, 25 bp, Rattus norvegicus
ttgttattgttccagcttgttacgc

SEQ ID NO: 686342 - DNA, 25 bp, Rattus norvegicus
ttgttattgttcgagcttgttacgc

SEQ ID NO: 686343 - DNA, 25 bp, Rattus norvegicus
ttgttatttttccttgactcctgct

SEQ ID NO: 686344 - DNA, 25 bp, Rattus norvegicus
ttgttatttttcgttgactcctgct

SEQ ID NO: 686345 - DNA, 25 bp, Rattus norvegicus
ttgttcaaaagtctgcccagtgcca

SEQ ID NO: 686346 - DNA, 25 bp, Rattus norvegicus
ttgttcaaaagtgtgcccagtgcca

SEQ ID NO: 686347 - DNA, 25 bp, Rattus norvegicus
ttgttcaagccgacacacctgttac

SEQ ID NO: 686348 - DNA, 25 bp, Rattus norvegicus
ttgttcaagccgtcacacctgttac

SEQ ID NO: 686349 - DNA, 25 bp, Rattus norvegicus
ttgttcaagcctctgatctttcctc

SEQ ID NO: 686350 - DNA, 25 bp, Rattus norvegicus
ttgttcaagcctgtgatctttcctc

SEQ ID NO: 686351 - DNA, 25 bp, Rattus norvegicus
ttgttcaatccccagtattcacatg

SEQ ID NO: 686352 - DNA, 25 bp, Rattus norvegicus
ttgttcaatcccgagtattcacatg

SEQ ID NO: 686353 - DNA, 25 bp, Rattus norvegicus
ttgttcacaaacacactcatggcca

SEQ ID NO: 686354 - DNA, 25 bp, Rattus norvegicus
ttgttcacaaactcactcatggcca

SEQ ID NO: 686355 - DNA, 25 bp, Rattus norvegicus
ttgttcacacacaggtcacctgtgg

SEQ ID NO: 686356 - DNA, 25 bp, Rattus norvegicus
ttgttcacacactggtcacctgtgg

SEQ ID NO: 686357 - DNA, 25 bp, Rattus norvegicus
ttgttcacacagattaggattttct

SEQ ID NO: 686358 - DNA, 25 bp, Rattus norvegicus
ttgttcacacagtttaggattttct

SEQ ID NO: 686359 - DNA, 25 bp, Rattus norvegicus
ttgttcacagccattgtcctcggga

SEQ ID NO: 686360 - DNA, 25 bp, Rattus norvegicus
ttgttcacagcctttgtcctcggga

SEQ ID NO: 686361 - DNA, 25 bp, Rattus norvegicus
ttgttcaccattagcacccaggagg

SEQ ID NO: 686362 - DNA, 25 bp, Rattus norvegicus
ttgttcaccatttgcacccaggagg

SEQ ID NO: 686363 - DNA, 25 bp, Rattus norvegicus
ttgttcacccaactgtaggttcacc

SEQ ID NO: 686364 - DNA, 25 bp, Rattus norvegicus
ttgttcacccaagtgtaggttcacc

SEQ ID NO: 686365 - DNA, 25 bp, Rattus norvegicus
ttgttcactctcaggacaatggcca

SEQ ID NO: 686366 - DNA, 25 bp, Rattus norvegicus
ttgttcactctctggacaatggcca

SEQ ID NO: 686367 - DNA, 25 bp, Rattus norvegicus
ttgttcagaacaaccagccagtggg

SEQ ID NO: 686368 - DNA, 25 bp, Rattus norvegicus
ttgttcagaacatccagccagtggg

SEQ ID NO: 686369 - DNA, 25 bp, Rattus norvegicus
ttgttcagacttcccagattaaaga

SEQ ID NO: 686370 - DNA, 25 bp, Rattus norvegicus
ttgttcagacttgccagattaaaga

SEQ ID NO: 686371 - DNA, 25 bp, Rattus norvegicus
ttgttcaggtcacaggctggtgcca

SEQ ID NO: 686372 - DNA, 25 bp, Rattus norvegicus
ttgttcaggtcagaggctggtgcca

SEQ ID NO: 686373 - DNA, 25 bp, Rattus norvegicus
ttgttcagtacacgagaggtccctt

SEQ ID NO: 686374 - DNA, 25 bp, Rattus norvegicus
ttgttcagtacaggagaggtccctt

SEQ ID NO: 686375 - DNA, 25 bp, Rattus norvegicus
ttgttcagttccagaagcatttcct

SEQ ID NO: 686376 - DNA, 25 bp, Rattus norvegicus
ttgttcagttcctgaagcatttcct

SEQ ID NO: 686377 - DNA, 25 bp, Rattus norvegicus
ttgttcatcaaaatctccactgcct

SEQ ID NO: 686378 - DNA, 25 bp, Rattus norvegicus
ttgttcatcaaattctccactgcct

SEQ ID NO: 686379 - DNA, 25 bp, Rattus norvegicus
ttgttcatcagtaacgagccctgcc

SEQ ID NO: 686380 - DNA, 25 bp, Rattus norvegicus
ttgttcatcagttacgagccctgcc

SEQ ID NO: 686381 - DNA, 25 bp, Rattus norvegicus
ttgttcatcatccttcattgccaag

SEQ ID NO: 686382 - DNA, 25 bp, Rattus norvegicus
ttgttcatcatcgttcattgccaag

SEQ ID NO: 686383 - DNA, 25 bp, Rattus norvegicus
ttgttcatcgttctgcctaaagcat

SEQ ID NO: 686384 - DNA, 25 bp, Rattus norvegicus
ttgttcatcgttgtgcctaaagcat

SEQ ID NO: 686385 - DNA, 25 bp, Rattus norvegicus
ttgttcatctttcggccctggagaa

SEQ ID NO: 686386 - DNA, 25 bp, Rattus norvegicus
ttgttcatctttgggccctggagaa

SEQ ID NO: 686387 - DNA, 25 bp, Rattus norvegicus
ttgttcatgataccagttgagttgt

SEQ ID NO: 686388 - DNA, 25 bp, Rattus norvegicus
ttgttcatgatagcagttgagttgt

SEQ ID NO: 686389 - DNA, 25 bp, Rattus norvegicus
ttgttcatgcccctttctcttttct

SEQ ID NO: 686390 - DNA, 25 bp, Rattus norvegicus
ttgttcatgcccgtttctcttttct

SEQ ID NO: 686391 - DNA, 25 bp, Rattus norvegicus
ttgttcatggacaagacccactgcc

SEQ ID NO: 686392 - DNA, 25 bp, Rattus norvegicus
ttgttcatggactagacccactgcc

SEQ ID NO: 686393 - DNA, 25 bp, Rattus norvegicus
ttgttcatgtcaactcctgcactta

SEQ ID NO: 686394 - DNA, 25 bp, Rattus norvegicus
ttgttcatgtcatctcctgcactta

SEQ ID NO: 686395 - DNA, 25 bp, Rattus norvegicus
ttgttcatgtcgcagctgctgtgta

SEQ ID NO: 686396 - DNA, 25 bp, Rattus norvegicus
ttgttcatgtcggagctgctgtgta

SEQ ID NO: 686397 - DNA, 25 bp, Rattus norvegicus
ttgttccaaagccaagcttcagcca

SEQ ID NO: 686398 - DNA, 25 bp, Rattus norvegicus
ttgttccaaagcgaagcttcagcca

SEQ ID NO: 686399 - DNA, 25 bp, Rattus norvegicus
ttgttccaaccgctgatcctccaga

SEQ ID NO: 686400 - DNA, 25 bp, Rattus norvegicus
ttgttccaaccggtgatcctccaga

SEQ ID NO: 686401 - DNA, 25 bp, Rattus norvegicus
ttgttccagattataccctcactat

SEQ ID NO: 686402 - DNA, 25 bp, Rattus norvegicus
ttgttccagattttaccctcactat

SEQ ID NO: 686403 - DNA, 25 bp, Rattus norvegicus
ttgttccagcttatccacacggcat

SEQ ID NO: 686404 - DNA, 25 bp, Rattus norvegicus
ttgttccagcttttccacacggcat

SEQ ID NO: 686405 - DNA, 25 bp, Rattus norvegicus
ttgttccatcttagtattcgtatcg

SEQ ID NO: 686406 - DNA, 25 bp, Rattus norvegicus
ttgttccatctttgtattcgtatcg

SEQ ID NO: 686407 - DNA, 25 bp, Rattus norvegicus
ttgttccatgctcctttcaagtata

SEQ ID NO: 686408 - DNA, 25 bp, Rattus norvegicus
ttgttccatgctgctttcaagtata

SEQ ID NO: 686409 - DNA, 25 bp, Rattus norvegicus
ttgttcccaaagaaggtagacctct

SEQ ID NO: 686410 - DNA, 25 bp, Rattus norvegicus
ttgttcccaaagtaggtagacctct

SEQ ID NO: 686411 - DNA, 25 bp, Rattus norvegicus
ttgttcccaagtatgcatgtgcctg

SEQ ID NO: 686412 - DNA, 25 bp, Rattus norvegicus
ttgttcccaagtttgcatgtgcctg

SEQ ID NO: 686413 - DNA, 25 bp, Rattus norvegicus
ttgttcccaatgctcatagtcacgg

SEQ ID NO: 686414 - DNA, 25 bp, Rattus norvegicus
ttgttcccaatggtcatagtcacgg

SEQ ID NO: 686415 - DNA, 25 bp, Rattus norvegicus
ttgttcccatttcttttccagtgtt

SEQ ID NO: 686416 - DNA, 25 bp, Rattus norvegicus
ttgttcccatttgttttccagtgtt

SEQ ID NO: 686417 - DNA, 25 bp, Rattus norvegicus
ttgttccccacactggccaagcgga

SEQ ID NO: 686418 - DNA, 25 bp, Rattus norvegicus
ttgttccccacagtggccaagcgga

SEQ ID NO: 686419 - DNA, 25 bp, Rattus norvegicus
ttgttccccagacgcacggaaacat

SEQ ID NO: 686420 - DNA, 25 bp, Rattus norvegicus
ttgttccccagaggcacggaaacat

SEQ ID NO: 686421 - DNA, 25 bp, Rattus norvegicus
ttgttcccctaaattaatgctgctt

SEQ ID NO: 686422 - DNA, 25 bp, Rattus norvegicus
ttgttcccctaatttaatgctgctt

SEQ ID NO: 686423 - DNA, 25 bp, Rattus norvegicus
ttgttccctctcacagtagggcatg

SEQ ID NO: 686424 - DNA, 25 bp, Rattus norvegicus
ttgttccctctctcagtagggcatg

SEQ ID NO: 686425 - DNA, 25 bp, Rattus norvegicus
ttgttcccttgaaatgactgaccag

SEQ ID NO: 686426 - DNA, 25 bp, Rattus norvegicus
ttgttcccttgatatgactgaccag

SEQ ID NO: 686427 - DNA, 25 bp, Rattus norvegicus
ttgttccgtgagaaaagtgcttgct

SEQ ID NO: 686428 - DNA, 25 bp, Rattus norvegicus
ttgttccgtgagtaaagtgcttgct

SEQ ID NO: 686429 - DNA, 25 bp, Rattus norvegicus
ttgttcctaaggatggcacgcagtt

SEQ ID NO: 686430 - DNA, 25 bp, Rattus norvegicus
ttgttcctaaggttggcacgcagtt

SEQ ID NO: 686431 - DNA, 25 bp, Rattus norvegicus
ttgttcctacagactatgccagcta

SEQ ID NO: 686432 - DNA, 25 bp, Rattus norvegicus
ttgttcctacagtctatgccagcta

SEQ ID NO: 686433 - DNA, 25 bp, Rattus norvegicus
ttgttcctagctcctgagctgtctc

SEQ ID NO: 686434 - DNA, 25 bp, Rattus norvegicus
ttgttcctagctgctgagctgtctc

SEQ ID NO: 686435 - DNA, 25 bp, Rattus norvegicus
ttgttcctcattatctcagtaatta

SEQ ID NO: 686436 - DNA, 25 bp, Rattus norvegicus
ttgttcctcattttctcagtaatta

SEQ ID NO: 686437 - DNA, 25 bp, Rattus norvegicus
ttgttcctcgccctaatctgtcatc

SEQ ID NO: 686438 - DNA, 25 bp, Rattus norvegicus
ttgttcctcgccgtaatctgtcatc

SEQ ID NO: 686439 - DNA, 25 bp, Rattus norvegicus
ttgttcctcttcaagctctttgttt

SEQ ID NO: 686440 - DNA, 25 bp, Rattus norvegicus
ttgttcctcttctagctctttgttt

SEQ ID NO: 686441 - DNA, 25 bp, Rattus norvegicus
ttgttcctctttagcatgtactcct

SEQ ID NO: 686442 - DNA, 25 bp, Rattus norvegicus
ttgttcctcttttgcatgtactcct

SEQ ID NO: 686443 - DNA, 25 bp, Rattus norvegicus
ttgttcctggtgaacctacagttaa

SEQ ID NO: 686444 - DNA, 25 bp, Rattus norvegicus
ttgttcctggtgtacctacagttaa

SEQ ID NO: 686445 - DNA, 25 bp, Rattus norvegicus
ttgttcctttttaaccctgactatg

SEQ ID NO: 686446 - DNA, 25 bp, Rattus norvegicus
ttgttccttttttaccctgactatg

SEQ ID NO: 686447 - DNA, 25 bp, Rattus norvegicus
ttgttcgagattcttcccaggtgca

SEQ ID NO: 686448 - DNA, 25 bp, Rattus norvegicus
ttgttcgagattgttcccaggtgca

SEQ ID NO: 686449 - DNA, 25 bp, Rattus norvegicus
ttgttcgaggtcacatttgtatttc

SEQ ID NO: 686450 - DNA, 25 bp, Rattus norvegicus
ttgttcgaggtctcatttgtatttc

SEQ ID NO: 686451 - DNA, 25 bp, Rattus norvegicus
ttgttcgatgatccaccccacaggc

SEQ ID NO: 686452 - DNA, 25 bp, Rattus norvegicus
ttgttcgatgatgcaccccacaggc

SEQ ID NO: 686453 - DNA, 25 bp, Rattus norvegicus
ttgttcgctaacaggtgcatattca

SEQ ID NO: 686454 - DNA, 25 bp, Rattus norvegicus
ttgttcgctaactggtgcatattca

SEQ ID NO: 686455 - DNA, 25 bp, Rattus norvegicus
ttgttcggacttagccatcgggcat

SEQ ID NO: 686456 - DNA, 25 bp, Rattus norvegicus
ttgttcggactttgccatcgggcat

SEQ ID NO: 686457 - DNA, 25 bp, Rattus norvegicus
ttgttcggccttatctgtaattgat

SEQ ID NO: 686458 - DNA, 25 bp, Rattus norvegicus
ttgttcggccttttctgtaattgat

SEQ ID NO: 686459 - DNA, 25 bp, Rattus norvegicus
ttgttcggtagtacagtctctgggc

SEQ ID NO: 686460 - DNA, 25 bp, Rattus norvegicus
ttgttcggtagttcagtctctgggc

SEQ ID NO: 686461 - DNA, 25 bp, Rattus norvegicus
ttgttcgtacgccttggacgcctgg

SEQ ID NO: 686462 - DNA, 25 bp, Rattus norvegicus
ttgttcgtacgcgttggacgcctgg

SEQ ID NO: 686463 - DNA, 25 bp, Rattus norvegicus
ttgttctaaccacgtgcaaagtggg

SEQ ID NO: 686464 - DNA, 25 bp, Rattus norvegicus
ttgttctaaccaggtgcaaagtggg

SEQ ID NO: 686465 - DNA, 25 bp, Rattus norvegicus
ttgttctaggctctcttatgttcat

SEQ ID NO: 686466 - DNA, 25 bp, Rattus norvegicus
ttgttctaggctgtcttatgttcat

SEQ ID NO: 686467 - DNA, 25 bp, Rattus norvegicus
ttgttctatccactggtggccagta

SEQ ID NO: 686468 - DNA, 25 bp, Rattus norvegicus
ttgttctatccagtggtggccagta

SEQ ID NO: 686469 - DNA, 25 bp, Rattus norvegicus
ttgttctatgatactcctttgctga

SEQ ID NO: 686470 - DNA, 25 bp, Rattus norvegicus
ttgttctatgattctcctttgctga

SEQ ID NO: 686471 - DNA, 25 bp, Rattus norvegicus
ttgttctattaaactgctgcgttca

SEQ ID NO: 686472 - DNA, 25 bp, Rattus norvegicus
ttgttctattaatctgctgcgttca

SEQ ID NO: 686473 - DNA, 25 bp, Rattus norvegicus
ttgttctcaaggatctagcactcca

SEQ ID NO: 686474 - DNA, 25 bp, Rattus norvegicus
ttgttctcaaggttctagcactcca

SEQ ID NO: 686475 - DNA, 25 bp, Rattus norvegicus
ttgttctcagctagtttagactaaa

SEQ ID NO: 686476 - DNA, 25 bp, Rattus norvegicus
ttgttctcagcttgtttagactaaa

SEQ ID NO: 686477 - DNA, 25 bp, Rattus norvegicus
ttgttctccactctgaagcactaga

SEQ ID NO: 686478 - DNA, 25 bp, Rattus norvegicus
ttgttctccactgtgaagcactaga

SEQ ID NO: 686479 - DNA, 25 bp, Rattus norvegicus
ttgttctcctcaaatcctgagctaa

SEQ ID NO: 686480 - DNA, 25 bp, Rattus norvegicus
ttgttctcctcaacgtcttgacagg

SEQ ID NO: 686481 - DNA, 25 bp, Rattus norvegicus
ttgttctcctcatatcctgagctaa

SEQ ID NO: 686482 - DNA, 25 bp, Rattus norvegicus
ttgttctcctcatcgtcttgacagg

SEQ ID NO: 686483 - DNA, 25 bp, Rattus norvegicus
ttgttctcgctgagggtatttgttc

SEQ ID NO: 686484 - DNA, 25 bp, Rattus norvegicus
ttgttctcgctgtgggtatttgttc

SEQ ID NO: 686485 - DNA, 25 bp, Rattus norvegicus
ttgttctctaggaaccctgtggtgg

SEQ ID NO: 686486 - DNA, 25 bp, Rattus norvegicus
ttgttctctaggtaccctgtggtgg

SEQ ID NO: 686487 - DNA, 25 bp, Rattus norvegicus
ttgttctctcctctaagtcttttct

SEQ ID NO: 686488 - DNA, 25 bp, Rattus norvegicus
ttgttctctcctgtaagtcttttct

SEQ ID NO: 686489 - DNA, 25 bp, Rattus norvegicus
ttgttctctgatagcacatgcagtg

SEQ ID NO: 686490 - DNA, 25 bp, Rattus norvegicus
ttgttctctgatctaattggcgtta

SEQ ID NO: 686491 - DNA, 25 bp, Rattus norvegicus
ttgttctctgatgtaattggcgtta

SEQ ID NO: 686492 - DNA, 25 bp, Rattus norvegicus
ttgttctctgattgcacatgcagtg

SEQ ID NO: 686493 - DNA, 25 bp, Rattus norvegicus
ttgttctgaagcagcccggtgagaa

SEQ ID NO: 686494 - DNA, 25 bp, Rattus norvegicus
ttgttctgaagcctacatcaccatt

SEQ ID NO: 686495 - DNA, 25 bp, Rattus norvegicus
ttgttctgaagcgtacatcaccatt

SEQ ID NO: 686496 - DNA, 25 bp, Rattus norvegicus
ttgttctgaagctgcccggtgagaa

SEQ ID NO: 686497 - DNA, 25 bp, Rattus norvegicus
ttgttctgaatgatggtagtccctt

SEQ ID NO: 686498 - DNA, 25 bp, Rattus norvegicus
ttgttctgaatgttggtagtccctt

SEQ ID NO: 686499 - DNA, 25 bp, Rattus norvegicus
ttgttctgactgacatctttttccc

SEQ ID NO: 686500 - DNA, 25 bp, Rattus norvegicus
ttgttctgactgtcatctttttccc

SEQ ID NO: 686501 - DNA, 25 bp, Rattus norvegicus
ttgttctgaggtagtcttcactctt

SEQ ID NO: 686502 - DNA, 25 bp, Rattus norvegicus
ttgttctgaggttgtcttcactctt

SEQ ID NO: 686503 - DNA, 25 bp, Rattus norvegicus
ttgttctgatcaagaattctgtcat

SEQ ID NO: 686504 - DNA, 25 bp, Rattus norvegicus
ttgttctgatcatgaattctgtcat

SEQ ID NO: 686505 - DNA, 25 bp, Rattus norvegicus
ttgttctgcactatgggagagcggc

SEQ ID NO: 686506 - DNA, 25 bp, Rattus norvegicus
ttgttctgcactttgggagagcggc

SEQ ID NO: 686507 - DNA, 25 bp, Rattus norvegicus
ttgttctgcatcagtacccttgagc

SEQ ID NO: 686508 - DNA, 25 bp, Rattus norvegicus
ttgttctgcatctgtacccttgagc

SEQ ID NO: 686509 - DNA, 25 bp, Rattus norvegicus
ttgttctgcgagaggccgatgtagc

SEQ ID NO: 686510 - DNA, 25 bp, Rattus norvegicus
ttgttctgcgagtggccgatgtagc

SEQ ID NO: 686511 - DNA, 25 bp, Rattus norvegicus
ttgttctgcttaaactaactgcgag

SEQ ID NO: 686512 - DNA, 25 bp, Rattus norvegicus
ttgttctgcttatactaactgcgag

SEQ ID NO: 686513 - DNA, 25 bp, Rattus norvegicus
ttgttctggcaaactaaggtccctc

SEQ ID NO: 686514 - DNA, 25 bp, Rattus norvegicus
ttgttctggcaatctaaggtccctc

SEQ ID NO: 686515 - DNA, 25 bp, Rattus norvegicus
ttgttctgtagacggttaaccccat

SEQ ID NO: 686516 - DNA, 25 bp, Rattus norvegicus
ttgttctgtagagggttaaccccat

SEQ ID NO: 686517 - DNA, 25 bp, Rattus norvegicus
ttgttctgtagcactgagcctgttt

SEQ ID NO: 686518 - DNA, 25 bp, Rattus norvegicus
ttgttctgtagctctgagcctgttt

SEQ ID NO: 686519 - DNA, 25 bp, Rattus norvegicus
ttgttctgtgacagtaggcggagaa

SEQ ID NO: 686520 - DNA, 25 bp, Rattus norvegicus
ttgttctgtgactgtaggcggagaa

SEQ ID NO: 686521 - DNA, 25 bp, Rattus norvegicus
ttgttctgttttctcgttttatgga

SEQ ID NO: 686522 - DNA, 25 bp, Rattus norvegicus
ttgttctgttttgtcgttttatgga

SEQ ID NO: 686523 - DNA, 25 bp, Rattus norvegicus
ttgttcttagtcatggcccatgtct

SEQ ID NO: 686524 - DNA, 25 bp, Rattus norvegicus
ttgttcttagtcttggcccatgtct

SEQ ID NO: 686525 - DNA, 25 bp, Rattus norvegicus
ttgttcttcaacatgggagcccagc

SEQ ID NO: 686526 - DNA, 25 bp, Rattus norvegicus
ttgttcttcaacttgggagcccagc

SEQ ID NO: 686527 - DNA, 25 bp, Rattus norvegicus
ttgttcttcaggattgtcatccgat

SEQ ID NO: 686528 - DNA, 25 bp, Rattus norvegicus
ttgttcttcaggtttgtcatccgat

SEQ ID NO: 686529 - DNA, 25 bp, Rattus norvegicus
ttgttcttcctaaggcattgcgacc

SEQ ID NO: 686530 - DNA, 25 bp, Rattus norvegicus
ttgttcttcctatggcattgcgacc

SEQ ID NO: 686531 - DNA, 25 bp, Rattus norvegicus
ttgttcttgccaccagtcagagctt

SEQ ID NO: 686532 - DNA, 25 bp, Rattus norvegicus
ttgttcttgccagcagtcagagctt

SEQ ID NO: 686533 - DNA, 25 bp, Rattus norvegicus
ttgttcttggagctttggctgtctt

SEQ ID NO: 686534 - DNA, 25 bp, Rattus norvegicus
ttgttcttggaggtttggctgtctt

SEQ ID NO: 686535 - DNA, 25 bp, Rattus norvegicus
ttgttctttgggagcgctctagtga

SEQ ID NO: 686536 - DNA, 25 bp, Rattus norvegicus
ttgttctttgggtgcgctctagtga

SEQ ID NO: 686537 - DNA, 25 bp, Rattus norvegicus
ttgttctttgttcgcaaatccccgg

SEQ ID NO: 686538 - DNA, 25 bp, Rattus norvegicus
ttgttctttgttggcaaatccccgg

SEQ ID NO: 686539 - DNA, 25 bp, Rattus norvegicus
ttgttcttttccatctggtcctcct

SEQ ID NO: 686540 - DNA, 25 bp, Rattus norvegicus
ttgttcttttccttctggtcctcct

SEQ ID NO: 686541 - DNA, 25 bp, Rattus norvegicus
ttgttcttttctcgttttcctgtgt

SEQ ID NO: 686542 - DNA, 25 bp, Rattus norvegicus
ttgttcttttctggttttcctgtgt

SEQ ID NO: 686543 - DNA, 25 bp, Rattus norvegicus
ttgttgaaccagagacccgttgcgt

SEQ ID NO: 686544 - DNA, 25 bp, Rattus norvegicus
ttgttgaaccagtgacccgttgcgt

SEQ ID NO: 686545 - DNA, 25 bp, Rattus norvegicus
ttgttgaatgtcatccatgtcctgt

SEQ ID NO: 686546 - DNA, 25 bp, Rattus norvegicus
ttgttgaatgtcttccatgtcctgt

SEQ ID NO: 686547 - DNA, 25 bp, Rattus norvegicus
ttgttgacaggcatgaccttcatgt

SEQ ID NO: 686548 - DNA, 25 bp, Rattus norvegicus
ttgttgacaggcttgaccttcatgt

SEQ ID NO: 686549 - DNA, 25 bp, Rattus norvegicus
ttgttgagccatctctaggcagaat

SEQ ID NO: 686550 - DNA, 25 bp, Rattus norvegicus
ttgttgagccatgtctaggcagaat

SEQ ID NO: 686551 - DNA, 25 bp, Rattus norvegicus
ttgttgagtggcaaaaaatccgtca

SEQ ID NO: 686552 - DNA, 25 bp, Rattus norvegicus
ttgttgagtggctaaaaatccgtca

SEQ ID NO: 686553 - DNA, 25 bp, Rattus norvegicus
ttgttgatttccagctcttcacaca

SEQ ID NO: 686554 - DNA, 25 bp, Rattus norvegicus
ttgttgatttcctgctcttcacaca

SEQ ID NO: 686555 - DNA, 25 bp, Rattus norvegicus
ttgttgcacaacaccatagactcac

SEQ ID NO: 686556 - DNA, 25 bp, Rattus norvegicus
ttgttgcacaactccatagactcac

SEQ ID NO: 686557 - DNA, 25 bp, Rattus norvegicus
ttgttgcacttaccagccatgtggt

SEQ ID NO: 686558 - DNA, 25 bp, Rattus norvegicus
ttgttgcacttagcagccatgtggt

SEQ ID NO: 686559 - DNA, 25 bp, Rattus norvegicus
ttgttgccaactacctgttactttc

SEQ ID NO: 686560 - DNA, 25 bp, Rattus norvegicus
ttgttgccaacttcctgttactttc

SEQ ID NO: 686561 - DNA, 25 bp, Rattus norvegicus
ttgttgccacacaatgatcatctat

SEQ ID NO: 686562 - DNA, 25 bp, Rattus norvegicus
ttgttgccacactatgatcatctat

SEQ ID NO: 686563 - DNA, 25 bp, Rattus norvegicus
ttgttgccaccacagaaagtgcctg

SEQ ID NO: 686564 - DNA, 25 bp, Rattus norvegicus
ttgttgccaccagagaaagtgcctg

SEQ ID NO: 686565 - DNA, 25 bp, Rattus norvegicus
ttgttgccatgcctccagggagagc

SEQ ID NO: 686566 - DNA, 25 bp, Rattus norvegicus
ttgttgccatgcgtccagggagagc

SEQ ID NO: 686567 - DNA, 25 bp, Rattus norvegicus
ttgttgcccagcctgacagtctaat

SEQ ID NO: 686568 - DNA, 25 bp, Rattus norvegicus
ttgttgcccagcgtgacagtctaat

SEQ ID NO: 686569 - DNA, 25 bp, Rattus norvegicus
ttgttgccgtgacctccacgagaca

SEQ ID NO: 686570 - DNA, 25 bp, Rattus norvegicus
ttgttgccgtgagctccacgagaca

SEQ ID NO: 686571 - DNA, 25 bp, Rattus norvegicus
ttgttgcctagccagctctgagaac

SEQ ID NO: 686572 - DNA, 25 bp, Rattus norvegicus
ttgttgcctagcgagctctgagaac

SEQ ID NO: 686573 - DNA, 25 bp, Rattus norvegicus
ttgttgcctattcagttctgtgcca

SEQ ID NO: 686574 - DNA, 25 bp, Rattus norvegicus
ttgttgcctattgagttctgtgcca

SEQ ID NO: 686575 - DNA, 25 bp, Rattus norvegicus
ttgttgcctcgacctagttctttac

SEQ ID NO: 686576 - DNA, 25 bp, Rattus norvegicus
ttgttgcctcgagctagttctttac

SEQ ID NO: 686577 - DNA, 25 bp, Rattus norvegicus
ttgttgcctttaagacacctgcttt

SEQ ID NO: 686578 - DNA, 25 bp, Rattus norvegicus
ttgttgcctttatgacacctgcttt

SEQ ID NO: 686579 - DNA, 25 bp, Rattus norvegicus
ttgttgctaatgatcctttctggtc

SEQ ID NO: 686580 - DNA, 25 bp, Rattus norvegicus
ttgttgctaatgttcctttctggtc

SEQ ID NO: 686581 - DNA, 25 bp, Rattus norvegicus
ttgttgctacagctctagctgggct

SEQ ID NO: 686582 - DNA, 25 bp, Rattus norvegicus
ttgttgctacaggtctagctgggct

SEQ ID NO: 686583 - DNA, 25 bp, Rattus norvegicus
ttgttgctacctcgttctgactcca

SEQ ID NO: 686584 - DNA, 25 bp, Rattus norvegicus
ttgttgctacctggttctgactcca

SEQ ID NO: 686585 - DNA, 25 bp, Rattus norvegicus
ttgttgctcaaacctcttctctggc

SEQ ID NO: 686586 - DNA, 25 bp, Rattus norvegicus
ttgttgctcaaagctcttctctggc

SEQ ID NO: 686587 - DNA, 25 bp, Rattus norvegicus
ttgttgctcagtccaaatacggtga

SEQ ID NO: 686588 - DNA, 25 bp, Rattus norvegicus
ttgttgctcagtgcaaatacggtga

SEQ ID NO: 686589 - DNA, 25 bp, Rattus norvegicus
ttgttgctcatcagcgagttcacac

SEQ ID NO: 686590 - DNA, 25 bp, Rattus norvegicus
ttgttgctcatctgcgagttcacac

SEQ ID NO: 686591 - DNA, 25 bp, Rattus norvegicus
ttgttgctcttcatgcgaatcgcca

SEQ ID NO: 686592 - DNA, 25 bp, Rattus norvegicus
ttgttgctcttcatggtgtcttccg

SEQ ID NO: 686593 - DNA, 25 bp, Rattus norvegicus
ttgttgctcttcttgcgaatcgcca

SEQ ID NO: 686594 - DNA, 25 bp, Rattus norvegicus
ttgttgctcttcttggtgtcttccg

SEQ ID NO: 686595 - DNA, 25 bp, Rattus norvegicus
ttgttgctctttccgaggacccagc

SEQ ID NO: 686596 - DNA, 25 bp, Rattus norvegicus
ttgttgctctttgcgaggacccagc

SEQ ID NO: 686597 - DNA, 25 bp, Rattus norvegicus
ttgttgctggataccttcgcataga

SEQ ID NO: 686598 - DNA, 25 bp, Rattus norvegicus
ttgttgctggattccttcgcataga

SEQ ID NO: 686599 - DNA, 25 bp, Rattus norvegicus
ttgttgctgttgacttgtctattgt

SEQ ID NO: 686600 - DNA, 25 bp, Rattus norvegicus
ttgttgctgttgtcttgtctattgt

SEQ ID NO: 686601 - DNA, 25 bp, Rattus norvegicus
ttgttgctttatctcttattttgtc

SEQ ID NO: 686602 - DNA, 25 bp, Rattus norvegicus
ttgttgctttatgtcttattttgtc

SEQ ID NO: 686603 - DNA, 25 bp, Rattus norvegicus
ttgttggaagggactgccagcctcc

SEQ ID NO: 686604 - DNA, 25 bp, Rattus norvegicus
ttgttggaagggtctgccagcctcc

SEQ ID NO: 686605 - DNA, 25 bp, Rattus norvegicus
ttgttggagccacaagccttgagta

SEQ ID NO: 686606 - DNA, 25 bp, Rattus norvegicus
ttgttggagccagaagccttgagta

SEQ ID NO: 686607 - DNA, 25 bp, Rattus norvegicus
ttgttggcagcgaggtgcaccagat

SEQ ID NO: 686608 - DNA, 25 bp, Rattus norvegicus
ttgttggcagcgtggtgcaccagat

SEQ ID NO: 686609 - DNA, 25 bp, Rattus norvegicus
ttgttggccgcaaatcccagttcaa

SEQ ID NO: 686610 - DNA, 25 bp, Rattus norvegicus
ttgttggccgcatatcccagttcaa

SEQ ID NO: 686611 - DNA, 25 bp, Rattus norvegicus
ttgttggcctgcaccagcatattgt

SEQ ID NO: 686612 - DNA, 25 bp, Rattus norvegicus
ttgttggcctgctccagcatattgt

SEQ ID NO: 686613 - DNA, 25 bp, Rattus norvegicus
ttgttggccttaatttcctgtgaaa

SEQ ID NO: 686614 - DNA, 25 bp, Rattus norvegicus
ttgttggccttattttcctgtgaaa

SEQ ID NO: 686615 - DNA, 25 bp, Rattus norvegicus
ttgttggctcctcactacgtaccca

SEQ ID NO: 686616 - DNA, 25 bp, Rattus norvegicus
ttgttggctcctgactacgtaccca

SEQ ID NO: 686617 - DNA, 25 bp, Rattus norvegicus
ttgttggctcttcttcagcgaacac

SEQ ID NO: 686618 - DNA, 25 bp, Rattus norvegicus
ttgttggctcttgttcagcgaacac

SEQ ID NO: 686619 - DNA, 25 bp, Rattus norvegicus
ttgttggctggacttccccggagaa

SEQ ID NO: 686620 - DNA, 25 bp, Rattus norvegicus
ttgttggctggagttccccggagaa

SEQ ID NO: 686621 - DNA, 25 bp, Rattus norvegicus
ttgttggcttatatcactgtggctc

SEQ ID NO: 686622 - DNA, 25 bp, Rattus norvegicus
ttgttggcttatttcactgtggctc

SEQ ID NO: 686623 - DNA, 25 bp, Rattus norvegicus
ttgttggctttcataggttctatta

SEQ ID NO: 686624 - DNA, 25 bp, Rattus norvegicus
ttgttggctttcttaggttctatta

SEQ ID NO: 686625 - DNA, 25 bp, Rattus norvegicus
ttgttgggagagaccccatcctgta

SEQ ID NO: 686626 - DNA, 25 bp, Rattus norvegicus
ttgttgggagagtccccatcctgta

SEQ ID NO: 686627 - DNA, 25 bp, Rattus norvegicus
ttgttgggataaaagccccgcgaaa

SEQ ID NO: 686628 - DNA, 25 bp, Rattus norvegicus
ttgttgggataatagccccgcgaaa

SEQ ID NO: 686629 - DNA, 25 bp, Rattus norvegicus
ttgttgggcagacgtcctggaccac

SEQ ID NO: 686630 - DNA, 25 bp, Rattus norvegicus
ttgttgggcagaggtcctggaccac

SEQ ID NO: 686631 - DNA, 25 bp, Rattus norvegicus
ttgttggtaattctcctggtcactt

SEQ ID NO: 686632 - DNA, 25 bp, Rattus norvegicus
ttgttggtaattgtcctggtcactt

SEQ ID NO: 686633 - DNA, 25 bp, Rattus norvegicus
ttgttggtcaccatccccatttgct

SEQ ID NO: 686634 - DNA, 25 bp, Rattus norvegicus
ttgttggtcaccttccccatttgct

SEQ ID NO: 686635 - DNA, 25 bp, Rattus norvegicus
ttgttggtctgtagtaccatggccc

SEQ ID NO: 686636 - DNA, 25 bp, Rattus norvegicus
ttgttggtctgttgtaccatggccc

SEQ ID NO: 686637 - DNA, 25 bp, Rattus norvegicus
ttgttggtctttcttcccaaactga

SEQ ID NO: 686638 - DNA, 25 bp, Rattus norvegicus
ttgttggtctttgttcccaaactga

SEQ ID NO: 686639 - DNA, 25 bp, Rattus norvegicus
ttgttggtgattcggactcctctgc

SEQ ID NO: 686640 - DNA, 25 bp, Rattus norvegicus
ttgttggtgattgggactcctctgc

SEQ ID NO: 686641 - DNA, 25 bp, Rattus norvegicus
ttgttggtgctcatccttaggaagt

SEQ ID NO: 686642 - DNA, 25 bp, Rattus norvegicus
ttgttggtgctcttccttaggaagt

SEQ ID NO: 686643 - DNA, 25 bp, Rattus norvegicus
ttgttggtgtccctggtcgataaga

SEQ ID NO: 686644 - DNA, 25 bp, Rattus norvegicus
ttgttggtgtccgtggtcgataaga

SEQ ID NO: 686645 - DNA, 25 bp, Rattus norvegicus
ttgttgtacaaaacactcttcccac

SEQ ID NO: 686646 - DNA, 25 bp, Rattus norvegicus
ttgttgtacaaatcactcttcccac

SEQ ID NO: 686647 - DNA, 25 bp, Rattus norvegicus
ttgttgtaccacagcctgtcggacg

SEQ ID NO: 686648 - DNA, 25 bp, Rattus norvegicus
ttgttgtaccactgcctgtcggacg

SEQ ID NO: 686649 - DNA, 25 bp, Rattus norvegicus
ttgttgtacctaagactgttgcctg

SEQ ID NO: 686650 - DNA, 25 bp, Rattus norvegicus
ttgttgtacctatgactgttgcctg

SEQ ID NO: 686651 - DNA, 25 bp, Rattus norvegicus
ttgttgtactctcgactgatctgca

SEQ ID NO: 686652 - DNA, 25 bp, Rattus norvegicus
ttgttgtactctggactgatctgca

SEQ ID NO: 686653 - DNA, 25 bp, Rattus norvegicus
ttgttgtagcagactcttaccctgg

SEQ ID NO: 686654 - DNA, 25 bp, Rattus norvegicus
ttgttgtagcagtctcttaccctgg

SEQ ID NO: 686655 - DNA, 25 bp, Rattus norvegicus
ttgttgtccatcaaaatctccctga

SEQ ID NO: 686656 - DNA, 25 bp, Rattus norvegicus
ttgttgtccatctaaatctccctga

SEQ ID NO: 686657 - DNA, 25 bp, Rattus norvegicus
ttgttgtctattctgcttatgctgg

SEQ ID NO: 686658 - DNA, 25 bp, Rattus norvegicus
ttgttgtctattgtgcttatgctgg

SEQ ID NO: 686659 - DNA, 25 bp, Rattus norvegicus
ttgttgtgcacacgcatgaccacca

SEQ ID NO: 686660 - DNA, 25 bp, Rattus norvegicus
ttgttgtgcacaggcatgaccacca

SEQ ID NO: 686661 - DNA, 25 bp, Rattus norvegicus
ttgttgtgctgtaactaaagttctg

SEQ ID NO: 686662 - DNA, 25 bp, Rattus norvegicus
ttgttgtgctgttactaaagttctg

SEQ ID NO: 686663 - DNA, 25 bp, Rattus norvegicus
ttgttgtggctgctctcagcagaca

SEQ ID NO: 686664 - DNA, 25 bp, Rattus norvegicus
ttgttgtggctggtctcagcagaca

SEQ ID NO: 686665 - DNA, 25 bp, Rattus norvegicus
ttgttgtgtcagcaattgtcagaat

SEQ ID NO: 686666 - DNA, 25 bp, Rattus norvegicus
ttgttgtgtcaggaattgtcagaat

SEQ ID NO: 686667 - DNA, 25 bp, Rattus norvegicus
ttgttgttaaagcagaagtctccat

SEQ ID NO: 686668 - DNA, 25 bp, Rattus norvegicus
ttgttgttaaaggagaagtctccat

SEQ ID NO: 686669 - DNA, 25 bp, Rattus norvegicus
ttgttgttacctcaattgcccttta

SEQ ID NO: 686670 - DNA, 25 bp, Rattus norvegicus
ttgttgttacctgaattgcccttta

SEQ ID NO: 686671 - DNA, 25 bp, Rattus norvegicus
ttgttgttcacacattactccagct

SEQ ID NO: 686672 - DNA, 25 bp, Rattus norvegicus
ttgttgttcacagattactccagct

SEQ ID NO: 686673 - DNA, 25 bp, Rattus norvegicus
ttgttgttcctaatcttctgacctt

SEQ ID NO: 686674 - DNA, 25 bp, Rattus norvegicus
ttgttgttcctattcttctgacctt

SEQ ID NO: 686675 - DNA, 25 bp, Rattus norvegicus
ttgttgttcctgacagtaccactat

SEQ ID NO: 686676 - DNA, 25 bp, Rattus norvegicus
ttgttgttcctgtcagtaccactat

SEQ ID NO: 686677 - DNA, 25 bp, Rattus norvegicus
ttgttgttctctcttaggtatgcac

SEQ ID NO: 686678 - DNA, 25 bp, Rattus norvegicus
ttgttgttctctgttaggtatgcac

SEQ ID NO: 686679 - DNA, 25 bp, Rattus norvegicus
ttgttgttcttgatgctcttgttaa

SEQ ID NO: 686680 - DNA, 25 bp, Rattus norvegicus
ttgttgttcttgttgctcttgttaa

SEQ ID NO: 686681 - DNA, 25 bp, Rattus norvegicus
ttgttgttgccaagttcattccctc

SEQ ID NO: 686682 - DNA, 25 bp, Rattus norvegicus
ttgttgttgccatgttcattccctc

SEQ ID NO: 686683 - DNA, 25 bp, Rattus norvegicus
ttgttgttgtcgattgtttcttgtt

SEQ ID NO: 686684 - DNA, 25 bp, Rattus norvegicus
ttgttgttgtcgtttgtttcttgtt

SEQ ID NO: 686685 - DNA, 25 bp, Rattus norvegicus
ttgttgttttcccttctaccttgtg

SEQ ID NO: 686686 - DNA, 25 bp, Rattus norvegicus
ttgttgttttccgttctaccttgtg

SEQ ID NO: 686687 - DNA, 25 bp, Rattus norvegicus
ttgttgtttttcactctggacagta

SEQ ID NO: 686688 - DNA, 25 bp, Rattus norvegicus
ttgttgtttttccatggcttttgcc

SEQ ID NO: 686689 - DNA, 25 bp, Rattus norvegicus
ttgttgtttttcgatggcttttgcc

SEQ ID NO: 686690 - DNA, 25 bp, Rattus norvegicus
ttgttgtttttctctctggacagta

SEQ ID NO: 686691 - DNA, 25 bp, Rattus norvegicus
ttgtttaaaccaagacagccaccct

SEQ ID NO: 686692 - DNA, 25 bp, Rattus norvegicus
ttgtttaaaccatgacagccaccct

SEQ ID NO: 686693 - DNA, 25 bp, Rattus norvegicus
ttgtttaaagagctctctccttccc

SEQ ID NO: 686694 - DNA, 25 bp, Rattus norvegicus
ttgtttaaagaggtctctccttccc

SEQ ID NO: 686695 - DNA, 25 bp, Rattus norvegicus
ttgtttaacggcagtgtcatcccct

SEQ ID NO: 686696 - DNA, 25 bp, Rattus norvegicus
ttgtttaacggctgtgtcatcccct

SEQ ID NO: 686697 - DNA, 25 bp, Rattus norvegicus
ttgtttaataacacggagctccgca

SEQ ID NO: 686698 - DNA, 25 bp, Rattus norvegicus
ttgtttaataactcggagctccgca

SEQ ID NO: 686699 - DNA, 25 bp, Rattus norvegicus
ttgtttaatgacctggttgcccagc

SEQ ID NO: 686700 - DNA, 25 bp, Rattus norvegicus
ttgtttaatgacgtggttgcccagc

SEQ ID NO: 686701 - DNA, 25 bp, Rattus norvegicus
ttgtttacaacacccaatagagtgc

SEQ ID NO: 686702 - DNA, 25 bp, Rattus norvegicus
ttgtttacaacagccaatagagtgc

SEQ ID NO: 686703 - DNA, 25 bp, Rattus norvegicus
ttgtttacacgtagtttctatcata

SEQ ID NO: 686704 - DNA, 25 bp, Rattus norvegicus
ttgtttacacgttgtttctatcata

SEQ ID NO: 686705 - DNA, 25 bp, Rattus norvegicus
ttgtttacaggccatgcagttaccc

SEQ ID NO: 686706 - DNA, 25 bp, Rattus norvegicus
ttgtttacaggcgatgcagttaccc

SEQ ID NO: 686707 - DNA, 25 bp, Rattus norvegicus
ttgtttacattcatcatcccagact

SEQ ID NO: 686708 - DNA, 25 bp, Rattus norvegicus
ttgtttacattcttcatcccagact

SEQ ID NO: 686709 - DNA, 25 bp, Rattus norvegicus
ttgtttaccactctttcttctccac

SEQ ID NO: 686710 - DNA, 25 bp, Rattus norvegicus
ttgtttaccactgtttcttctccac

SEQ ID NO: 686711 - DNA, 25 bp, Rattus norvegicus
ttgtttactcagctgtaagtcccct

SEQ ID NO: 686712 - DNA, 25 bp, Rattus norvegicus
ttgtttactcaggtgtaagtcccct

SEQ ID NO: 686713 - DNA, 25 bp, Rattus norvegicus
ttgtttagcaaacctggagccctgg

SEQ ID NO: 686714 - DNA, 25 bp, Rattus norvegicus
ttgtttagcaaagctggagccctgg

SEQ ID NO: 686715 - DNA, 25 bp, Rattus norvegicus
ttgtttagcacactcttcccagaat

SEQ ID NO: 686716 - DNA, 25 bp, Rattus norvegicus
ttgtttagcacagtcttcccagaat

SEQ ID NO: 686717 - DNA, 25 bp, Rattus norvegicus
ttgtttatatcactcctttttgtga

SEQ ID NO: 686718 - DNA, 25 bp, Rattus norvegicus
ttgtttatatcagtcctttttgtga

SEQ ID NO: 686719 - DNA, 25 bp, Rattus norvegicus
ttgtttatccctctctcttaggagg

SEQ ID NO: 686720 - DNA, 25 bp, Rattus norvegicus
ttgtttatccctgtctcttaggagg

SEQ ID NO: 686721 - DNA, 25 bp, Rattus norvegicus
ttgtttatcgtgaagtccacctaaa

SEQ ID NO: 686722 - DNA, 25 bp, Rattus norvegicus
ttgtttatcgtgtagtccacctaaa

SEQ ID NO: 686723 - DNA, 25 bp, Rattus norvegicus
ttgtttatctcccttgcattgcatg

SEQ ID NO: 686724 - DNA, 25 bp, Rattus norvegicus
ttgtttatctccgttgcattgcatg

SEQ ID NO: 686725 - DNA, 25 bp, Rattus norvegicus
ttgtttcaaataatctagtagcact

SEQ ID NO: 686726 - DNA, 25 bp, Rattus norvegicus
ttgtttcaaatattctagtagcact

SEQ ID NO: 686727 - DNA, 25 bp, Rattus norvegicus
ttgtttcaaattcccctggcttagt

SEQ ID NO: 686728 - DNA, 25 bp, Rattus norvegicus
ttgtttcaaattgccctggcttagt

SEQ ID NO: 686729 - DNA, 25 bp, Rattus norvegicus
ttgtttcaactcctcctgcaaataa

SEQ ID NO: 686730 - DNA, 25 bp, Rattus norvegicus
ttgtttcaactcgtcctgcaaataa

SEQ ID NO: 686731 - DNA, 25 bp, Rattus norvegicus
ttgtttcacatcagcagactctggg

SEQ ID NO: 686732 - DNA, 25 bp, Rattus norvegicus
ttgtttcacatctgcagactctggg

SEQ ID NO: 686733 - DNA, 25 bp, Rattus norvegicus
ttgtttcacgagctgaacagtgaca

SEQ ID NO: 686734 - DNA, 25 bp, Rattus norvegicus
ttgtttcacgaggtgaacagtgaca

SEQ ID NO: 686735 - DNA, 25 bp, Rattus norvegicus
ttgtttcacttccaattccttccaa

SEQ ID NO: 686736 - DNA, 25 bp, Rattus norvegicus
ttgtttcacttcgaattccttccaa

SEQ ID NO: 686737 - DNA, 25 bp, Rattus norvegicus
ttgtttcagtctccatgcttgctaa

SEQ ID NO: 686738 - DNA, 25 bp, Rattus norvegicus
ttgtttcagtctgcatgcttgctaa

SEQ ID NO: 686739 - DNA, 25 bp, Rattus norvegicus
ttgtttcagtgacggcccctgagca

SEQ ID NO: 686740 - DNA, 25 bp, Rattus norvegicus
ttgtttcagtgagggcccctgagca

SEQ ID NO: 686741 - DNA, 25 bp, Rattus norvegicus
ttgtttccacagctggcagtaagcc

SEQ ID NO: 686742 - DNA, 25 bp, Rattus norvegicus
ttgtttccacaggtggcagtaagcc

SEQ ID NO: 686743 - DNA, 25 bp, Rattus norvegicus
ttgtttccacccactttcaggtgaa

SEQ ID NO: 686744 - DNA, 25 bp, Rattus norvegicus
ttgtttccaccctctttcaggtgaa

SEQ ID NO: 686745 - DNA, 25 bp, Rattus norvegicus
ttgtttccagcccaggagtcctcat

SEQ ID NO: 686746 - DNA, 25 bp, Rattus norvegicus
ttgtttccagccgaggagtcctcat

SEQ ID NO: 686747 - DNA, 25 bp, Rattus norvegicus
ttgtttccaggtagtcagacgtcga

SEQ ID NO: 686748 - DNA, 25 bp, Rattus norvegicus
ttgtttccaggttgtcagacgtcga

SEQ ID NO: 686749 - DNA, 25 bp, Rattus norvegicus
ttgtttcccattccataatgcctga

SEQ ID NO: 686750 - DNA, 25 bp, Rattus norvegicus
ttgtttcccattgcataatgcctga

SEQ ID NO: 686751 - DNA, 25 bp, Rattus norvegicus
ttgtttcccttgctttatttgaata

SEQ ID NO: 686752 - DNA, 25 bp, Rattus norvegicus
ttgtttcccttggtttatttgaata

SEQ ID NO: 686753 - DNA, 25 bp, Rattus norvegicus
ttgtttccctttctgttggagctat

SEQ ID NO: 686754 - DNA, 25 bp, Rattus norvegicus
ttgtttccctttgtgttggagctat

SEQ ID NO: 686755 - DNA, 25 bp, Rattus norvegicus
ttgtttcctaaacatgtcctggcta

SEQ ID NO: 686756 - DNA, 25 bp, Rattus norvegicus
ttgtttcctaaagatgtcctggcta

SEQ ID NO: 686757 - DNA, 25 bp, Rattus norvegicus
ttgtttcctaccagtgtgcatttta

SEQ ID NO: 686758 - DNA, 25 bp, Rattus norvegicus
ttgtttcctacctgtgtgcatttta

SEQ ID NO: 686759 - DNA, 25 bp, Rattus norvegicus
ttgtttcctgaactgggttgggcca

SEQ ID NO: 686760 - DNA, 25 bp, Rattus norvegicus
ttgtttcctgaagtgggttgggcca

SEQ ID NO: 686761 - DNA, 25 bp, Rattus norvegicus
ttgtttcctgtaaccttcactctgt

SEQ ID NO: 686762 - DNA, 25 bp, Rattus norvegicus
ttgtttcctgtatccttcactctgt

SEQ ID NO: 686763 - DNA, 25 bp, Rattus norvegicus
ttgtttccttacaaatcctcgcatg

SEQ ID NO: 686764 - DNA, 25 bp, Rattus norvegicus
ttgtttccttactaatcctcgcatg

SEQ ID NO: 686765 - DNA, 25 bp, Rattus norvegicus
ttgtttccttgtcgttacgctggga

SEQ ID NO: 686766 - DNA, 25 bp, Rattus norvegicus
ttgtttccttgtggttacgctggga

SEQ ID NO: 686767 - DNA, 25 bp, Rattus norvegicus
ttgtttccttttatgctagtgcttc

SEQ ID NO: 686768 - DNA, 25 bp, Rattus norvegicus
ttgtttccttttcatacccgctcat

SEQ ID NO: 686769 - DNA, 25 bp, Rattus norvegicus
ttgtttccttttgatacccgctcat

SEQ ID NO: 686770 - DNA, 25 bp, Rattus norvegicus
ttgtttccttttttgctagtgcttc

SEQ ID NO: 686771 - DNA, 25 bp, Rattus norvegicus
ttgtttcgaagcattcccaccatgg

SEQ ID NO: 686772 - DNA, 25 bp, Rattus norvegicus
ttgtttcgaagctttcccaccatgg

SEQ ID NO: 686773 - DNA, 25 bp, Rattus norvegicus
ttgtttcgtgataagttttccccat

SEQ ID NO: 686774 - DNA, 25 bp, Rattus norvegicus
ttgtttcgtgattagttttccccat

SEQ ID NO: 686775 - DNA, 25 bp, Rattus norvegicus
ttgtttcgtgttctttccagttaga

SEQ ID NO: 686776 - DNA, 25 bp, Rattus norvegicus
ttgtttcgtgttgtttccagttaga

SEQ ID NO: 686777 - DNA, 25 bp, Rattus norvegicus
ttgtttctagcgctcctgtagcatc

SEQ ID NO: 686778 - DNA, 25 bp, Rattus norvegicus
ttgtttctagcggtcctgtagcatc

SEQ ID NO: 686779 - DNA, 25 bp, Rattus norvegicus
ttgtttctcactacaggcaagctga

SEQ ID NO: 686780 - DNA, 25 bp, Rattus norvegicus
ttgtttctcacttcaggcaagctga

SEQ ID NO: 686781 - DNA, 25 bp, Rattus norvegicus
ttgtttctcagaactttacccttcg

SEQ ID NO: 686782 - DNA, 25 bp, Rattus norvegicus
ttgtttctcagatctttacccttcg

SEQ ID NO: 686783 - DNA, 25 bp, Rattus norvegicus
ttgtttctcatgaagggtctgttcg

SEQ ID NO: 686784 - DNA, 25 bp, Rattus norvegicus
ttgtttctcatgtagggtctgttcg

SEQ ID NO: 686785 - DNA, 25 bp, Rattus norvegicus
ttgtttctccaaatcaccgtgagac

SEQ ID NO: 686786 - DNA, 25 bp, Rattus norvegicus
ttgtttctccaattcaccgtgagac

SEQ ID NO: 686787 - DNA, 25 bp, Rattus norvegicus
ttgtttctccagattcccttgtcct

SEQ ID NO: 686788 - DNA, 25 bp, Rattus norvegicus
ttgtttctccagtttcccttgtcct

SEQ ID NO: 686789 - DNA, 25 bp, Rattus norvegicus
ttgtttctctatacactgccttttg

SEQ ID NO: 686790 - DNA, 25 bp, Rattus norvegicus
ttgtttctctattcactgccttttg

SEQ ID NO: 686791 - DNA, 25 bp, Rattus norvegicus
ttgtttctctccaggttttgtaaat

SEQ ID NO: 686792 - DNA, 25 bp, Rattus norvegicus
ttgtttctctcctggttttgtaaat

SEQ ID NO: 686793 - DNA, 25 bp, Rattus norvegicus
ttgtttctctgtacatcacagcagt

SEQ ID NO: 686794 - DNA, 25 bp, Rattus norvegicus
ttgtttctctgttcatcacagcagt

SEQ ID NO: 686795 - DNA, 25 bp, Rattus norvegicus
ttgtttctgggtaccgaagtaatgc

SEQ ID NO: 686796 - DNA, 25 bp, Rattus norvegicus
ttgtttctgggttccgaagtaatgc

SEQ ID NO: 686797 - DNA, 25 bp, Rattus norvegicus
ttgtttctgtacatttttggcataa

SEQ ID NO: 686798 - DNA, 25 bp, Rattus norvegicus
ttgtttctgtacttttttggcataa

SEQ ID NO: 686799 - DNA, 25 bp, Rattus norvegicus
ttgtttctgtccaaggtcattcaca

SEQ ID NO: 686800 - DNA, 25 bp, Rattus norvegicus
ttgtttctgtcctaggtcattcaca

SEQ ID NO: 686801 - DNA, 25 bp, Rattus norvegicus
ttgtttctgtctaaggtcatccata

SEQ ID NO: 686802 - DNA, 25 bp, Rattus norvegicus
ttgtttctgtcttaggtcatccata

SEQ ID NO: 686803 - DNA, 25 bp, Rattus norvegicus
ttgtttctgtttctgagcatccgga

SEQ ID NO: 686804 - DNA, 25 bp, Rattus norvegicus
ttgtttctgtttgtgagcatccgga

SEQ ID NO: 686805 - DNA, 25 bp, Rattus norvegicus
ttgtttcttctgaaccaagcctgtg

SEQ ID NO: 686806 - DNA, 25 bp, Rattus norvegicus
ttgtttcttctgtaccaagcctgtg

SEQ ID NO: 686807 - DNA, 25 bp, Rattus norvegicus
ttgtttcttgctccttgtggtaaag

SEQ ID NO: 686808 - DNA, 25 bp, Rattus norvegicus
ttgtttcttgctgcttgtggtaaag

SEQ ID NO: 686809 - DNA, 25 bp, Rattus norvegicus
ttgtttcttgtcattgttcccacac

SEQ ID NO: 686810 - DNA, 25 bp, Rattus norvegicus
ttgtttcttgtctttgttcccacac

SEQ ID NO: 686811 - DNA, 25 bp, Rattus norvegicus
ttgtttctttccacctaactatgac

SEQ ID NO: 686812 - DNA, 25 bp, Rattus norvegicus
ttgtttctttcctcctaactatgac

SEQ ID NO: 686813 - DNA, 25 bp, Rattus norvegicus
ttgtttgaacccagtccctttccat

SEQ ID NO: 686814 - DNA, 25 bp, Rattus norvegicus
ttgtttgaaccctgtccctttccat

SEQ ID NO: 686815 - DNA, 25 bp, Rattus norvegicus
ttgtttgatatccataaggcgtgta

SEQ ID NO: 686816 - DNA, 25 bp, Rattus norvegicus
ttgtttgatatcgataaggcgtgta

SEQ ID NO: 686817 - DNA, 25 bp, Rattus norvegicus
ttgtttgatcttcgtctcttttctc

SEQ ID NO: 686818 - DNA, 25 bp, Rattus norvegicus
ttgtttgatcttggtctcttttctc

SEQ ID NO: 686819 - DNA, 25 bp, Rattus norvegicus
ttgtttgcaactatggacctcaaga

SEQ ID NO: 686820 - DNA, 25 bp, Rattus norvegicus
ttgtttgcaactttggacctcaaga

SEQ ID NO: 686821 - DNA, 25 bp, Rattus norvegicus
ttgtttgcagaacttctcctcctac

SEQ ID NO: 686822 - DNA, 25 bp, Rattus norvegicus
ttgtttgcagaagttctcctcctac

SEQ ID NO: 686823 - DNA, 25 bp, Rattus norvegicus
ttgtttgcagcgaccagatggccat

SEQ ID NO: 686824 - DNA, 25 bp, Rattus norvegicus
ttgtttgcagcgtccagatggccat

SEQ ID NO: 686825 - DNA, 25 bp, Rattus norvegicus
ttgtttgccaaacccagagtctccc

SEQ ID NO: 686826 - DNA, 25 bp, Rattus norvegicus
ttgtttgccaaagccagagtctccc

SEQ ID NO: 686827 - DNA, 25 bp, Rattus norvegicus
ttgtttgccttgcacatcactgtcg

SEQ ID NO: 686828 - DNA, 25 bp, Rattus norvegicus
ttgtttgccttggacatcactgtcg

SEQ ID NO: 686829 - DNA, 25 bp, Rattus norvegicus
ttgtttgcgctccatccgcgcacgg

SEQ ID NO: 686830 - DNA, 25 bp, Rattus norvegicus
ttgtttgcgctcgatccgcgcacgg

SEQ ID NO: 686831 - DNA, 25 bp, Rattus norvegicus
ttgtttgctgtaagtctctgctcac

SEQ ID NO: 686832 - DNA, 25 bp, Rattus norvegicus
ttgtttgctgtatgtctctgctcac

SEQ ID NO: 686833 - DNA, 25 bp, Rattus norvegicus
ttgtttgctgtgcttcccgctttcc

SEQ ID NO: 686834 - DNA, 25 bp, Rattus norvegicus
ttgtttgctgtggttcccgctttcc

SEQ ID NO: 686835 - DNA, 25 bp, Rattus norvegicus
ttgtttgcttaaattccttctgtta

SEQ ID NO: 686836 - DNA, 25 bp, Rattus norvegicus
ttgtttgcttaatttccttctgtta

SEQ ID NO: 686837 - DNA, 25 bp, Rattus norvegicus
ttgtttggaagcctcttcctccggg

SEQ ID NO: 686838 - DNA, 25 bp, Rattus norvegicus
ttgtttggaagcgtcttcctccggg

SEQ ID NO: 686839 - DNA, 25 bp, Rattus norvegicus
ttgtttggccaaagcagcacagtat

SEQ ID NO: 686840 - DNA, 25 bp, Rattus norvegicus
ttgtttggccaatgcagcacagtat

SEQ ID NO: 686841 - DNA, 25 bp, Rattus norvegicus
ttgtttgggtctcaactgcttctca

SEQ ID NO: 686842 - DNA, 25 bp, Rattus norvegicus
ttgtttgggtctgaactgcttctca

SEQ ID NO: 686843 - DNA, 25 bp, Rattus norvegicus
ttgtttgggttcatttgttctgtat

SEQ ID NO: 686844 - DNA, 25 bp, Rattus norvegicus
ttgtttgggttcttttgttctgtat

SEQ ID NO: 686845 - DNA, 25 bp, Rattus norvegicus
ttgtttgtaagacctggcttctctg

SEQ ID NO: 686846 - DNA, 25 bp, Rattus norvegicus
ttgtttgtaagagctggcttctctg

SEQ ID NO: 686847 - DNA, 25 bp, Rattus norvegicus
ttgtttgtacctagcaaacttacaa

SEQ ID NO: 686848 - DNA, 25 bp, Rattus norvegicus
ttgtttgtaccttgcaaacttacaa

SEQ ID NO: 686849 - DNA, 25 bp, Rattus norvegicus
ttgtttgtagtcctctgtctgtcca

SEQ ID NO: 686850 - DNA, 25 bp, Rattus norvegicus
ttgtttgtagtcgtctgtctgtcca

SEQ ID NO: 686851 - DNA, 25 bp, Rattus norvegicus
ttgtttgtcaatcatcccttctgtt

SEQ ID NO: 686852 - DNA, 25 bp, Rattus norvegicus
ttgtttgtcaatgatcccttctgtt

SEQ ID NO: 686853 - DNA, 25 bp, Rattus norvegicus
ttgtttgtcagaattcagtgccact

SEQ ID NO: 686854 - DNA, 25 bp, Rattus norvegicus
ttgtttgtcagatttcagtgccact

SEQ ID NO: 686855 - DNA, 25 bp, Rattus norvegicus
ttgtttgtctataaatggccctgct

SEQ ID NO: 686856 - DNA, 25 bp, Rattus norvegicus
ttgtttgtctattaatggccctgct

SEQ ID NO: 686857 - DNA, 25 bp, Rattus norvegicus
ttgtttgtggacagcacccacaaat

SEQ ID NO: 686858 - DNA, 25 bp, Rattus norvegicus
ttgtttgtggactgcacccacaaat

SEQ ID NO: 686859 - DNA, 25 bp, Rattus norvegicus
ttgtttgtggttatgacttctcctc

SEQ ID NO: 686860 - DNA, 25 bp, Rattus norvegicus
ttgtttgtggttttgacttctcctc

SEQ ID NO: 686861 - DNA, 25 bp, Rattus norvegicus
ttgtttgtgttgacggtgactgctt

SEQ ID NO: 686862 - DNA, 25 bp, Rattus norvegicus
ttgtttgtgttgtcggtgactgctt

SEQ ID NO: 686863 - DNA, 25 bp, Rattus norvegicus
ttgtttgttcccacagtgctgaaga

SEQ ID NO: 686864 - DNA, 25 bp, Rattus norvegicus
ttgtttgttccctcagtgctgaaga

SEQ ID NO: 686865 - DNA, 25 bp, Rattus norvegicus
ttgtttgttctaagtgccctttgtc

SEQ ID NO: 686866 - DNA, 25 bp, Rattus norvegicus
ttgtttgttctatgtgccctttgtc

SEQ ID NO: 686867 - DNA, 25 bp, Rattus norvegicus
ttgtttgttcttcccggattgccct

SEQ ID NO: 686868 - DNA, 25 bp, Rattus norvegicus
ttgtttgttcttgccggattgccct

SEQ ID NO: 686869 - DNA, 25 bp, Rattus norvegicus
ttgtttgttggtatgagtctaaaag

SEQ ID NO: 686870 - DNA, 25 bp, Rattus norvegicus
ttgtttgttggtttgagtctaaaag

SEQ ID NO: 686871 - DNA, 25 bp, Rattus norvegicus
ttgtttgtttctctgcattccttga

SEQ ID NO: 686872 - DNA, 25 bp, Rattus norvegicus
ttgtttgtttctgtgcattccttga

SEQ ID NO: 686873 - DNA, 25 bp, Rattus norvegicus
ttgttttacaaaacagcctggcatg

SEQ ID NO: 686874 - DNA, 25 bp, Rattus norvegicus
ttgttttacaaatcagcctggcatg

SEQ ID NO: 686875 - DNA, 25 bp, Rattus norvegicus
ttgttttacacactctcccaactca

SEQ ID NO: 686876 - DNA, 25 bp, Rattus norvegicus
ttgttttacacagtctcccaactca

SEQ ID NO: 686877 - DNA, 25 bp, Rattus norvegicus
ttgttttaccacagagcgctctctg

SEQ ID NO: 686878 - DNA, 25 bp, Rattus norvegicus
ttgttttaccactgagcgctctctg

SEQ ID NO: 686879 - DNA, 25 bp, Rattus norvegicus
ttgttttacctcattatctcctggg

SEQ ID NO: 686880 - DNA, 25 bp, Rattus norvegicus
ttgttttacctctttatctcctggg

SEQ ID NO: 686881 - DNA, 25 bp, Rattus norvegicus
ttgttttagacacagcccatcttcc

SEQ ID NO: 686882 - DNA, 25 bp, Rattus norvegicus
ttgttttagacagagcccatcttcc

SEQ ID NO: 686883 - DNA, 25 bp, Rattus norvegicus
ttgttttatcttccacagtttgtga

SEQ ID NO: 686884 - DNA, 25 bp, Rattus norvegicus
ttgttttatcttgcacagtttgtga

SEQ ID NO: 686885 - DNA, 25 bp, Rattus norvegicus
ttgttttatgggagtacctgtcctc

SEQ ID NO: 686886 - DNA, 25 bp, Rattus norvegicus
ttgttttatgggtgtacctgtcctc

SEQ ID NO: 686887 - DNA, 25 bp, Rattus norvegicus
ttgttttcaaaaattccatagaact

SEQ ID NO: 686888 - DNA, 25 bp, Rattus norvegicus
ttgttttcaaaatttccatagaact

SEQ ID NO: 686889 - DNA, 25 bp, Rattus norvegicus
ttgttttcaagcagtctacaccgta

SEQ ID NO: 686890 - DNA, 25 bp, Rattus norvegicus
ttgttttcaagctgtctacaccgta

SEQ ID NO: 686891 - DNA, 25 bp, Rattus norvegicus
ttgttttcagaacatgattcttggg

SEQ ID NO: 686892 - DNA, 25 bp, Rattus norvegicus
ttgttttcagaagatgattcttggg

SEQ ID NO: 686893 - DNA, 25 bp, Rattus norvegicus
ttgttttcagcaatggtcccggtga

SEQ ID NO: 686894 - DNA, 25 bp, Rattus norvegicus
ttgttttcagcattggtcccggtga

SEQ ID NO: 686895 - DNA, 25 bp, Rattus norvegicus
ttgttttcattgataccactcccaa

SEQ ID NO: 686896 - DNA, 25 bp, Rattus norvegicus
ttgttttcattgttaccactcccaa

SEQ ID NO: 686897 - DNA, 25 bp, Rattus norvegicus
ttgttttccaaaacaggctttctgt

SEQ ID NO: 686898 - DNA, 25 bp, Rattus norvegicus
ttgttttccaaatcaggctttctgt

SEQ ID NO: 686899 - DNA, 25 bp, Rattus norvegicus
ttgttttccacaaatttaccctcgg

SEQ ID NO: 686900 - DNA, 25 bp, Rattus norvegicus
ttgttttccacatatttaccctcgg

SEQ ID NO: 686901 - DNA, 25 bp, Rattus norvegicus
ttgttttccaccctttagtattatg

SEQ ID NO: 686902 - DNA, 25 bp, Rattus norvegicus
ttgttttccaccgtttagtattatg

SEQ ID NO: 686903 - DNA, 25 bp, Rattus norvegicus
ttgttttccccaatgtaatgagcat

SEQ ID NO: 686904 - DNA, 25 bp, Rattus norvegicus
ttgttttccccattgtaatgagcat

SEQ ID NO: 686905 - DNA, 25 bp, Rattus norvegicus
ttgttttccctcaaggccagttctg

SEQ ID NO: 686906 - DNA, 25 bp, Rattus norvegicus
ttgttttccctctaggccagttctg

SEQ ID NO: 686907 - DNA, 25 bp, Rattus norvegicus
ttgttttcctgtcccatgtacagaa

SEQ ID NO: 686908 - DNA, 25 bp, Rattus norvegicus
ttgttttcctgtgccatgtacagaa

SEQ ID NO: 686909 - DNA, 25 bp, Rattus norvegicus
ttgttttccttacctttggcaggca

SEQ ID NO: 686910 - DNA, 25 bp, Rattus norvegicus
ttgttttccttagctttggcaggca

SEQ ID NO: 686911 - DNA, 25 bp, Rattus norvegicus
ttgttttccttcactcttctcatat

SEQ ID NO: 686912 - DNA, 25 bp, Rattus norvegicus
ttgttttccttctctcttctcatat

SEQ ID NO: 686913 - DNA, 25 bp, Rattus norvegicus
ttgttttcctttacaacccgtgcag

SEQ ID NO: 686914 - DNA, 25 bp, Rattus norvegicus
ttgttttccttttcaacccgtgcag

SEQ ID NO: 686915 - DNA, 25 bp, Rattus norvegicus
ttgttttcgtgcaagtgtccatagc

SEQ ID NO: 686916 - DNA, 25 bp, Rattus norvegicus
ttgttttcgtgctagtgtccatagc

SEQ ID NO: 686917 - DNA, 25 bp, Rattus norvegicus
ttgttttctatgatccactttcacc

SEQ ID NO: 686918 - DNA, 25 bp, Rattus norvegicus
ttgttttctatgttccactttcacc

SEQ ID NO: 686919 - DNA, 25 bp, Rattus norvegicus
ttgttttctccgcagagtcaccagt

SEQ ID NO: 686920 - DNA, 25 bp, Rattus norvegicus
ttgttttctccggagagtcaccagt

SEQ ID NO: 686921 - DNA, 25 bp, Rattus norvegicus
ttgttttctgcgatgtgctgtgtac

SEQ ID NO: 686922 - DNA, 25 bp, Rattus norvegicus
ttgttttctgcgttgtgctgtgtac

SEQ ID NO: 686923 - DNA, 25 bp, Rattus norvegicus
ttgttttctgtcactgatgctaatg

SEQ ID NO: 686924 - DNA, 25 bp, Rattus norvegicus
ttgttttctgtcagccatcaggcac

SEQ ID NO: 686925 - DNA, 25 bp, Rattus norvegicus
ttgttttctgtctctgatgctaatg

SEQ ID NO: 686926 - DNA, 25 bp, Rattus norvegicus
ttgttttctgtctgccatcaggcac

SEQ ID NO: 686927 - DNA, 25 bp, Rattus norvegicus
ttgttttctgtgactatgctgggta

SEQ ID NO: 686928 - DNA, 25 bp, Rattus norvegicus
ttgttttctgtgtctatgctgggta

SEQ ID NO: 686929 - DNA, 25 bp, Rattus norvegicus
ttgttttcttccagacggttttgag

SEQ ID NO: 686930 - DNA, 25 bp, Rattus norvegicus
ttgttttcttcctgacggttttgag

SEQ ID NO: 686931 - DNA, 25 bp, Rattus norvegicus
ttgttttcttggatctggctcagga

SEQ ID NO: 686932 - DNA, 25 bp, Rattus norvegicus
ttgttttcttggcatgggaggcttt

SEQ ID NO: 686933 - DNA, 25 bp, Rattus norvegicus
ttgttttcttgggatgggaggcttt

SEQ ID NO: 686934 - DNA, 25 bp, Rattus norvegicus
ttgttttcttggttctggctcagga

SEQ ID NO: 686935 - DNA, 25 bp, Rattus norvegicus
ttgttttcttgtacttctgtcccat

SEQ ID NO: 686936 - DNA, 25 bp, Rattus norvegicus
ttgttttcttgttcttctgtcccat

SEQ ID NO: 686937 - DNA, 25 bp, Rattus norvegicus
ttgttttgaacgcaagtactgactt

SEQ ID NO: 686938 - DNA, 25 bp, Rattus norvegicus
ttgttttgaacggaagtactgactt

SEQ ID NO: 686939 - DNA, 25 bp, Rattus norvegicus
ttgttttgaactaacggccatttgg

SEQ ID NO: 686940 - DNA, 25 bp, Rattus norvegicus
ttgttttgaacttacggccatttgg

SEQ ID NO: 686941 - DNA, 25 bp, Rattus norvegicus
ttgttttgcaaacacatcccggtgg

SEQ ID NO: 686942 - DNA, 25 bp, Rattus norvegicus
ttgttttgcaaagacatcccggtgg

SEQ ID NO: 686943 - DNA, 25 bp, Rattus norvegicus
ttgttttgcgtcacaaatgcctaaa

SEQ ID NO: 686944 - DNA, 25 bp, Rattus norvegicus
ttgttttgcgtctcaaatgcctaaa

SEQ ID NO: 686945 - DNA, 25 bp, Rattus norvegicus
ttgttttggcatcggtttcccagtc

SEQ ID NO: 686946 - DNA, 25 bp, Rattus norvegicus
ttgttttggcatgggtttcccagtc

SEQ ID NO: 686947 - DNA, 25 bp, Rattus norvegicus
ttgttttgtagaccctttcccaact

SEQ ID NO: 686948 - DNA, 25 bp, Rattus norvegicus
ttgttttgtagagcctttcccaact

SEQ ID NO: 686949 - DNA, 25 bp, Rattus norvegicus
ttgttttgtgcgagacgtggtccaa

SEQ ID NO: 686950 - DNA, 25 bp, Rattus norvegicus
ttgttttgtgcgtgacgtggtccaa

SEQ ID NO: 686951 - DNA, 25 bp, Rattus norvegicus
ttgttttgtgtccataacctcctgc

SEQ ID NO: 686952 - DNA, 25 bp, Rattus norvegicus
ttgttttgtgtcgataacctcctgc

SEQ ID NO: 686953 - DNA, 25 bp, Rattus norvegicus
ttgttttgttcaaagctcgcaggca

SEQ ID NO: 686954 - DNA, 25 bp, Rattus norvegicus
ttgttttgttcatagctcgcaggca

SEQ ID NO: 686955 - DNA, 25 bp, Rattus norvegicus
ttgttttgtttcacagtaactggtc

SEQ ID NO: 686956 - DNA, 25 bp, Rattus norvegicus
ttgttttgtttctcagtaactggtc

SEQ ID NO: 686957 - DNA, 25 bp, Rattus norvegicus
ttgtttttaacaccacggcaggagc

SEQ ID NO: 686958 - DNA, 25 bp, Rattus norvegicus
ttgtttttaacacccacttaatatg

SEQ ID NO: 686959 - DNA, 25 bp, Rattus norvegicus
ttgtttttaacagcacggcaggagc

SEQ ID NO: 686960 - DNA, 25 bp, Rattus norvegicus
ttgtttttaacagccacttaatatg

SEQ ID NO: 686961 - DNA, 25 bp, Rattus norvegicus
ttgtttttagcaccgactgtttcag

SEQ ID NO: 686962 - DNA, 25 bp, Rattus norvegicus
ttgtttttagcagcgactgtttcag

SEQ ID NO: 686963 - DNA, 25 bp, Rattus norvegicus
ttgtttttcattacgctctgcagag

SEQ ID NO: 686964 - DNA, 25 bp, Rattus norvegicus
ttgtttttcatttcgctctgcagag

SEQ ID NO: 686965 - DNA, 25 bp, Rattus norvegicus
ttgtttttgatacctcatgcaccct

SEQ ID NO: 686966 - DNA, 25 bp, Rattus norvegicus
ttgtttttgatagctcatgcaccct

SEQ ID NO: 686967 - DNA, 25 bp, Rattus norvegicus
ttgtttttgattcttaggccgcata

SEQ ID NO: 686968 - DNA, 25 bp, Rattus norvegicus
ttgtttttgattgttaggccgcata

SEQ ID NO: 686969 - DNA, 25 bp, Rattus norvegicus
ttgtttttgcatattgtccctacca

SEQ ID NO: 686970 - DNA, 25 bp, Rattus norvegicus
ttgtttttgcattttgtccctacca

SEQ ID NO: 686971 - DNA, 25 bp, Rattus norvegicus
ttgtttttggcccaggtccaaggcg

SEQ ID NO: 686972 - DNA, 25 bp, Rattus norvegicus
ttgtttttggccgaggtccaaggcg

SEQ ID NO: 686973 - DNA, 25 bp, Rattus norvegicus
ttgtttttggttatcatctcgtgtg

SEQ ID NO: 686974 - DNA, 25 bp, Rattus norvegicus
ttgtttttggttttcatctcgtgtg

SEQ ID NO: 686975 - DNA, 25 bp, Rattus norvegicus
ttgtttttgtagagctgacttgtct

SEQ ID NO: 686976 - DNA, 25 bp, Rattus norvegicus
ttgtttttgtagtgctgacttgtct

SEQ ID NO: 686977 - DNA, 25 bp, Rattus norvegicus
ttgttttttacactcgctgctctca

SEQ ID NO: 686978 - DNA, 25 bp, Rattus norvegicus
ttgttttttacagtcgctgctctca

SEQ ID NO: 686979 - DNA, 25 bp, Rattus norvegicus
ttgttttttcttcttggccatctgt

SEQ ID NO: 686980 - DNA, 25 bp, Rattus norvegicus
ttgttttttcttgttggccatctgt

SEQ ID NO: 686981 - DNA, 25 bp, Rattus norvegicus
ttgttttttgttacatggattggca

SEQ ID NO: 686982 - DNA, 25 bp, Rattus norvegicus
ttgttttttgtttcatggattggca

SEQ ID NO: 686983 - DNA, 25 bp, Rattus norvegicus
tttaaaaaaactccttctgccctgg

SEQ ID NO: 686984 - DNA, 25 bp, Rattus norvegicus
tttaaaaaaactgcttctgccctgg

SEQ ID NO: 686985 - DNA, 25 bp, Rattus norvegicus
tttaaaacacggctgagcctgcagt

SEQ ID NO: 686986 - DNA, 25 bp, Rattus norvegicus
tttaaaacacgggtgagcctgcagt

SEQ ID NO: 686987 - DNA, 25 bp, Rattus norvegicus
tttaaaacctcaatgtctccttgcc

SEQ ID NO: 686988 - DNA, 25 bp, Rattus norvegicus
tttaaaacctcattgtctccttgcc

SEQ ID NO: 686989 - DNA, 25 bp, Rattus norvegicus
tttaaaacgccgacctgcactgaaa

SEQ ID NO: 686990 - DNA, 25 bp, Rattus norvegicus
tttaaaacgccgtcctgcactgaaa

SEQ ID NO: 686991 - DNA, 25 bp, Rattus norvegicus
tttaaaactattctccaggctcctc

SEQ ID NO: 686992 - DNA, 25 bp, Rattus norvegicus
tttaaaactattgtccaggctcctc

SEQ ID NO: 686993 - DNA, 25 bp, Rattus norvegicus
tttaaaaggactcctgccttcagct

SEQ ID NO: 686994 - DNA, 25 bp, Rattus norvegicus
tttaaaaggactgctgccttcagct

SEQ ID NO: 686995 - DNA, 25 bp, Rattus norvegicus
tttaaaatagctaagccctctccct

SEQ ID NO: 686996 - DNA, 25 bp, Rattus norvegicus
tttaaaatagcttagccctctccct

SEQ ID NO: 686997 - DNA, 25 bp, Rattus norvegicus
tttaaaatgataacccccagcctat

SEQ ID NO: 686998 - DNA, 25 bp, Rattus norvegicus
tttaaaatgatatcccccagcctat

SEQ ID NO: 686999 - DNA, 25 bp, Rattus norvegicus
tttaaacaaagtcccaccctgcaat

SEQ ID NO: 687000 - DNA, 25 bp, Rattus norvegicus
tttaaacaaagtgccaccctgcaat

SEQ ID NO: 687001 - DNA, 25 bp, Rattus norvegicus
tttaaacacagcagccatgtcccgt

SEQ ID NO: 687002 - DNA, 25 bp, Rattus norvegicus
tttaaacacagctgccatgtcccgt

SEQ ID NO: 687003 - DNA, 25 bp, Rattus norvegicus
tttaaacacattctttgtctccaag

SEQ ID NO: 687004 - DNA, 25 bp, Rattus norvegicus
tttaaacacattgtttgtctccaag

SEQ ID NO: 687005 - DNA, 25 bp, Rattus norvegicus
tttaaacagcccctgtctggaactt

SEQ ID NO: 687006 - DNA, 25 bp, Rattus norvegicus
tttaaacagcccgtgtctggaactt

SEQ ID NO: 687007 - DNA, 25 bp, Rattus norvegicus
tttaaacagttgcattttctcctca

SEQ ID NO: 687008 - DNA, 25 bp, Rattus norvegicus
tttaaacagttggattttctcctca

SEQ ID NO: 687009 - DNA, 25 bp, Rattus norvegicus
tttaaacatcccaattctcatggcc

SEQ ID NO: 687010 - DNA, 25 bp, Rattus norvegicus
tttaaacatccctattctcatggcc

SEQ ID NO: 687011 - DNA, 25 bp, Rattus norvegicus
tttaaacatctgcacttccgccttc

SEQ ID NO: 687012 - DNA, 25 bp, Rattus norvegicus
tttaaacatctggacttccgccttc

SEQ ID NO: 687013 - DNA, 25 bp, Rattus norvegicus
tttaaaccaatgacttcttcacagt

SEQ ID NO: 687014 - DNA, 25 bp, Rattus norvegicus
tttaaaccaatgtcttcttcacagt

SEQ ID NO: 687015 - DNA, 25 bp, Rattus norvegicus
tttaaaccccaacatcaacaacctg

SEQ ID NO: 687016 - DNA, 25 bp, Rattus norvegicus
tttaaaccccaagatcaacaacctg

SEQ ID NO: 687017 - DNA, 25 bp, Rattus norvegicus
tttaaaccccatatctgctgagagt

SEQ ID NO: 687018 - DNA, 25 bp, Rattus norvegicus
tttaaaccccatttctgctgagagt

SEQ ID NO: 687019 - DNA, 25 bp, Rattus norvegicus
tttaaaccctcaatcctctgctttg

SEQ ID NO: 687020 - DNA, 25 bp, Rattus norvegicus
tttaaaccctcattcctctgctttg

SEQ ID NO: 687021 - DNA, 25 bp, Rattus norvegicus
tttaaaccctctctgcactgattca

SEQ ID NO: 687022 - DNA, 25 bp, Rattus norvegicus
tttaaaccctctgtgcactgattca

SEQ ID NO: 687023 - DNA, 25 bp, Rattus norvegicus
tttaaaccctgtctagcactgccaa

SEQ ID NO: 687024 - DNA, 25 bp, Rattus norvegicus
tttaaaccctgtgtagcactgccaa

SEQ ID NO: 687025 - DNA, 25 bp, Rattus norvegicus
tttaaacccttcaaagcacctcaga

SEQ ID NO: 687026 - DNA, 25 bp, Rattus norvegicus
tttaaacccttctaagcacctcaga

SEQ ID NO: 687027 - DNA, 25 bp, Rattus norvegicus
tttaaaccgttgactcctgaccagg

SEQ ID NO: 687028 - DNA, 25 bp, Rattus norvegicus
tttaaaccgttgtctcctgaccagg

SEQ ID NO: 687029 - DNA, 25 bp, Rattus norvegicus
tttaaacctctcaagctttctgggc

SEQ ID NO: 687030 - DNA, 25 bp, Rattus norvegicus
tttaaacctctctagctttctgggc

SEQ ID NO: 687031 - DNA, 25 bp, Rattus norvegicus
tttaaacctgttaatctaggacata

SEQ ID NO: 687032 - DNA, 25 bp, Rattus norvegicus
tttaaacctgtttatctaggacata

SEQ ID NO: 687033 - DNA, 25 bp, Rattus norvegicus
tttaaacgtggtcttttgcttccat

SEQ ID NO: 687034 - DNA, 25 bp, Rattus norvegicus
tttaaacgtggtgttttgcttccat

SEQ ID NO: 687035 - DNA, 25 bp, Rattus norvegicus
tttaaactacctaccactagtgtat

SEQ ID NO: 687036 - DNA, 25 bp, Rattus norvegicus
tttaaactaccttccactagtgtat

SEQ ID NO: 687037 - DNA, 25 bp, Rattus norvegicus
tttaaactagcaaacagcacaaagc

SEQ ID NO: 687038 - DNA, 25 bp, Rattus norvegicus
tttaaactagcatacagcacaaagc

SEQ ID NO: 687039 - DNA, 25 bp, Rattus norvegicus
tttaaactcgttctcccacatcttt

SEQ ID NO: 687040 - DNA, 25 bp, Rattus norvegicus
tttaaactcgttgtcccacatcttt

SEQ ID NO: 687041 - DNA, 25 bp, Rattus norvegicus
tttaaactgagaccagcgactcctc

SEQ ID NO: 687042 - DNA, 25 bp, Rattus norvegicus
tttaaactgagagcagcgactcctc

SEQ ID NO: 687043 - DNA, 25 bp, Rattus norvegicus
tttaaactgctgaaatggacacatt

SEQ ID NO: 687044 - DNA, 25 bp, Rattus norvegicus
tttaaactgctgtaatggacacatt

SEQ ID NO: 687045 - DNA, 25 bp, Rattus norvegicus
tttaaacttgctacctagtaagtgc

SEQ ID NO: 687046 - DNA, 25 bp, Rattus norvegicus
tttaaacttgcttcctagtaagtgc

SEQ ID NO: 687047 - DNA, 25 bp, Rattus norvegicus
tttaaacttggcctgcctgcaaagc

SEQ ID NO: 687048 - DNA, 25 bp, Rattus norvegicus
tttaaacttggcgtgcctgcaaagc

SEQ ID NO: 687049 - DNA, 25 bp, Rattus norvegicus
tttaaactttgcactttcaggcgga

SEQ ID NO: 687050 - DNA, 25 bp, Rattus norvegicus
tttaaactttgctctttcaggcgga

SEQ ID NO: 687051 - DNA, 25 bp, Rattus norvegicus
tttaaagaacgtctgttcccatgag

SEQ ID NO: 687052 - DNA, 25 bp, Rattus norvegicus
tttaaagaacgtgtgttcccatgag

SEQ ID NO: 687053 - DNA, 25 bp, Rattus norvegicus
tttaaagacaggcttcccgtcacag

SEQ ID NO: 687054 - DNA, 25 bp, Rattus norvegicus
tttaaagacagggttcccgtcacag

SEQ ID NO: 687055 - DNA, 25 bp, Rattus norvegicus
tttaaagaccggagccttcgcatct

SEQ ID NO: 687056 - DNA, 25 bp, Rattus norvegicus
tttaaagaccggtgccttcgcatct

SEQ ID NO: 687057 - DNA, 25 bp, Rattus norvegicus
tttaaagataaactgaaatgcacat

SEQ ID NO: 687058 - DNA, 25 bp, Rattus norvegicus
tttaaagataaagtgaaatgcacat

SEQ ID NO: 687059 - DNA, 25 bp, Rattus norvegicus
tttaaagatacacccctaacctcac

SEQ ID NO: 687060 - DNA, 25 bp, Rattus norvegicus
tttaaagatacagccctaacctcac

SEQ ID NO: 687061 - DNA, 25 bp, Rattus norvegicus
tttaaagatctactcccacctgagg

SEQ ID NO: 687062 - DNA, 25 bp, Rattus norvegicus
tttaaagatctagtcccacctgagg

SEQ ID NO: 687063 - DNA, 25 bp, Rattus norvegicus
tttaaagcactaccagccacattca

SEQ ID NO: 687064 - DNA, 25 bp, Rattus norvegicus
tttaaagcactagcagccacattca

SEQ ID NO: 687065 - DNA, 25 bp, Rattus norvegicus
tttaaagcacttctctagtcattga

SEQ ID NO: 687066 - DNA, 25 bp, Rattus norvegicus
tttaaagcacttgtctagtcattga

SEQ ID NO: 687067 - DNA, 25 bp, Rattus norvegicus
tttaaagcatgtcagcaatttccct

SEQ ID NO: 687068 - DNA, 25 bp, Rattus norvegicus
tttaaagcatgtgagcaatttccct

SEQ ID NO: 687069 - DNA, 25 bp, Rattus norvegicus
tttaaagccaagcaccgtcagaccg

SEQ ID NO: 687070 - DNA, 25 bp, Rattus norvegicus
tttaaagccaaggaccgtcagaccg

SEQ ID NO: 687071 - DNA, 25 bp, Rattus norvegicus
tttaaagccttcaccataccaatga

SEQ ID NO: 687072 - DNA, 25 bp, Rattus norvegicus
tttaaagccttctccataccaatga

SEQ ID NO: 687073 - DNA, 25 bp, Rattus norvegicus
tttaaagcgaagagtctgggtgtaa

SEQ ID NO: 687074 - DNA, 25 bp, Rattus norvegicus
tttaaagcgaagtgtctgggtgtaa

SEQ ID NO: 687075 - DNA, 25 bp, Rattus norvegicus
tttaaagctactagccacagtcctg

SEQ ID NO: 687076 - DNA, 25 bp, Rattus norvegicus
tttaaagctacttgccacagtcctg

SEQ ID NO: 687077 - DNA, 25 bp, Rattus norvegicus
tttaaagctctgcaaaatccccttc

SEQ ID NO: 687078 - DNA, 25 bp, Rattus norvegicus
tttaaagctctggaaaatccccttc

SEQ ID NO: 687079 - DNA, 25 bp, Rattus norvegicus
tttaaaggacttctctctgcctgga

SEQ ID NO: 687080 - DNA, 25 bp, Rattus norvegicus
tttaaaggacttgtctctgcctgga

SEQ ID NO: 687081 - DNA, 25 bp, Rattus norvegicus
tttaaaggccccagtaagcagaatt

SEQ ID NO: 687082 - DNA, 25 bp, Rattus norvegicus
tttaaaggcccctgtaagcagaatt

SEQ ID NO: 687083 - DNA, 25 bp, Rattus norvegicus
tttaaaggcgctctccgggagatcc

SEQ ID NO: 687084 - DNA, 25 bp, Rattus norvegicus
tttaaaggcgctgtccgggagatcc

SEQ ID NO: 687085 - DNA, 25 bp, Rattus norvegicus
tttaaaggctgcatccatgtgccgc

SEQ ID NO: 687086 - DNA, 25 bp, Rattus norvegicus
tttaaaggctgcttccatgtgccgc

SEQ ID NO: 687087 - DNA, 25 bp, Rattus norvegicus
tttaaaggctggcttaggtcattgg

SEQ ID NO: 687088 - DNA, 25 bp, Rattus norvegicus
tttaaaggctgggttaggtcattgg

SEQ ID NO: 687089 - DNA, 25 bp, Rattus norvegicus
tttaaagtcagaattcccctccctg

SEQ ID NO: 687090 - DNA, 25 bp, Rattus norvegicus
tttaaagtcagatttcccctccctg

SEQ ID NO: 687091 - DNA, 25 bp, Rattus norvegicus
tttaaagtcattctgctgcctcaag

SEQ ID NO: 687092 - DNA, 25 bp, Rattus norvegicus
tttaaagtcattgtgctgcctcaag

SEQ ID NO: 687093 - DNA, 25 bp, Rattus norvegicus
tttaaagtccagagtttcaacagtg

SEQ ID NO: 687094 - DNA, 25 bp, Rattus norvegicus
tttaaagtccagtgtttcaacagtg

SEQ ID NO: 687095 - DNA, 25 bp, Rattus norvegicus
tttaaagtgcagatccttcaacgga

SEQ ID NO: 687096 - DNA, 25 bp, Rattus norvegicus
tttaaagtgcagttccttcaacgga

SEQ ID NO: 687097 - DNA, 25 bp, Rattus norvegicus
tttaaagtgtttcacgtccgcccag

SEQ ID NO: 687098 - DNA, 25 bp, Rattus norvegicus
tttaaagtgtttgacgtccgcccag

SEQ ID NO: 687099 - DNA, 25 bp, Rattus norvegicus
tttaaagttgttcactcccacctcg

SEQ ID NO: 687100 - DNA, 25 bp, Rattus norvegicus
tttaaagttgttgactcccacctcg

SEQ ID NO: 687101 - DNA, 25 bp, Rattus norvegicus
tttaaataaattacacttgccattt

SEQ ID NO: 687102 - DNA, 25 bp, Rattus norvegicus
tttaaataaatttcacttgccattt

SEQ ID NO: 687103 - DNA, 25 bp, Rattus norvegicus
tttaaatagcctacaccttgtgtgt

SEQ ID NO: 687104 - DNA, 25 bp, Rattus norvegicus
tttaaatagccttcaccttgtgtgt

SEQ ID NO: 687105 - DNA, 25 bp, Rattus norvegicus
tttaaatatcacctcactgtggccc

SEQ ID NO: 687106 - DNA, 25 bp, Rattus norvegicus
tttaaatatcacgtcactgtggccc

SEQ ID NO: 687107 - DNA, 25 bp, Rattus norvegicus
tttaaatatctaatgcctcaagcaa

SEQ ID NO: 687108 - DNA, 25 bp, Rattus norvegicus
tttaaatatctattgcctcaagcaa

SEQ ID NO: 687109 - DNA, 25 bp, Rattus norvegicus
tttaaatatgctcaggtggccacaa

SEQ ID NO: 687110 - DNA, 25 bp, Rattus norvegicus
tttaaatatgctgaggtggccacaa

SEQ ID NO: 687111 - DNA, 25 bp, Rattus norvegicus
tttaaatcccctatatctccagcct

SEQ ID NO: 687112 - DNA, 25 bp, Rattus norvegicus
tttaaatcccctttatctccagcct

SEQ ID NO: 687113 - DNA, 25 bp, Rattus norvegicus
tttaaatcctggcagtcagcctctc

SEQ ID NO: 687114 - DNA, 25 bp, Rattus norvegicus
tttaaatcctgggagtcagcctctc

SEQ ID NO: 687115 - DNA, 25 bp, Rattus norvegicus
tttaaatctacacctgggaaagcca

SEQ ID NO: 687116 - DNA, 25 bp, Rattus norvegicus
tttaaatctacagctgggaaagcca

SEQ ID NO: 687117 - DNA, 25 bp, Rattus norvegicus
tttaaatgctggatgattcctccct

SEQ ID NO: 687118 - DNA, 25 bp, Rattus norvegicus
tttaaatgctggttgattcctccct

SEQ ID NO: 687119 - DNA, 25 bp, Rattus norvegicus
tttaaatggcagaggctttccccgg

SEQ ID NO: 687120 - DNA, 25 bp, Rattus norvegicus
tttaaatggcagtggctttccccgg

SEQ ID NO: 687121 - DNA, 25 bp, Rattus norvegicus
tttaaatgtcctcagtacgtctcct

SEQ ID NO: 687122 - DNA, 25 bp, Rattus norvegicus
tttaaatgtcctgagtacgtctcct

SEQ ID NO: 687123 - DNA, 25 bp, Rattus norvegicus
tttaaattcctgactccaggccgtg

SEQ ID NO: 687124 - DNA, 25 bp, Rattus norvegicus
tttaaattcctgtctccaggccgtg

SEQ ID NO: 687125 - DNA, 25 bp, Rattus norvegicus
tttaaattctcaatctctacctcac

SEQ ID NO: 687126 - DNA, 25 bp, Rattus norvegicus
tttaaattctcattctctacctcac

SEQ ID NO: 687127 - DNA, 25 bp, Rattus norvegicus
tttaaattgaggagccccacttctg

SEQ ID NO: 687128 - DNA, 25 bp, Rattus norvegicus
tttaaattgaggtgccccacttctg

SEQ ID NO: 687129 - DNA, 25 bp, Rattus norvegicus
tttaaatttctgctccccttgcaag

SEQ ID NO: 687130 - DNA, 25 bp, Rattus norvegicus
tttaaatttctggtccccttgcaag

SEQ ID NO: 687131 - DNA, 25 bp, Rattus norvegicus
tttaaatttcttcttggcttctgta

SEQ ID NO: 687132 - DNA, 25 bp, Rattus norvegicus
tttaaatttcttgttggcttctgta

SEQ ID NO: 687133 - DNA, 25 bp, Rattus norvegicus
tttaaattttttctgtgggctggag

SEQ ID NO: 687134 - DNA, 25 bp, Rattus norvegicus
tttaaattttttgtgtgggctggag

SEQ ID NO: 687135 - DNA, 25 bp, Rattus norvegicus
tttaacaaggttccccatgttctct

SEQ ID NO: 687136 - DNA, 25 bp, Rattus norvegicus
tttaacaaggttgcccatgttctct

SEQ ID NO: 687137 - DNA, 25 bp, Rattus norvegicus
tttaacaagtgcagcagttcgcccg

SEQ ID NO: 687138 - DNA, 25 bp, Rattus norvegicus
tttaacaagtgctgcagttcgcccg

SEQ ID NO: 687139 - DNA, 25 bp, Rattus norvegicus
tttaacacaagtaccacctctaggg

SEQ ID NO: 687140 - DNA, 25 bp, Rattus norvegicus
tttaacacaagttccacctctaggg

SEQ ID NO: 687141 - DNA, 25 bp, Rattus norvegicus
tttaacacctggatcagaagctaaa

SEQ ID NO: 687142 - DNA, 25 bp, Rattus norvegicus
tttaacacctggttcagaagctaaa

SEQ ID NO: 687143 - DNA, 25 bp, Rattus norvegicus
tttaacacgaaactctgtcctggcc

SEQ ID NO: 687144 - DNA, 25 bp, Rattus norvegicus
tttaacacgaaagtctgtcctggcc

SEQ ID NO: 687145 - DNA, 25 bp, Rattus norvegicus
tttaacacgtgacttccctttgacg

SEQ ID NO: 687146 - DNA, 25 bp, Rattus norvegicus
tttaacacgtgagttccctttgacg

SEQ ID NO: 687147 - DNA, 25 bp, Rattus norvegicus
tttaacatctccacgtccctagtat

SEQ ID NO: 687148 - DNA, 25 bp, Rattus norvegicus
tttaacatctcctcgtccctagtat

SEQ ID NO: 687149 - DNA, 25 bp, Rattus norvegicus
tttaacatggtcattctcaactttg

SEQ ID NO: 687150 - DNA, 25 bp, Rattus norvegicus
tttaacatggtctttctcaactttg

SEQ ID NO: 687151 - DNA, 25 bp, Rattus norvegicus
tttaacatgtggctgagcaaagcct

SEQ ID NO: 687152 - DNA, 25 bp, Rattus norvegicus
tttaacatgtgggtgagcaaagcct

SEQ ID NO: 687153 - DNA, 25 bp, Rattus norvegicus
tttaacatgtttccagcattcccag

SEQ ID NO: 687154 - DNA, 25 bp, Rattus norvegicus
tttaacatgtttgcagcattcccag

SEQ ID NO: 687155 - DNA, 25 bp, Rattus norvegicus
tttaacattcttagttcccctgaag

SEQ ID NO: 687156 - DNA, 25 bp, Rattus norvegicus
tttaacattctttgttcccctgaag

SEQ ID NO: 687157 - DNA, 25 bp, Rattus norvegicus
tttaaccagacaagtttctcccaac

SEQ ID NO: 687158 - DNA, 25 bp, Rattus norvegicus
tttaaccagacatgtttctcccaac

SEQ ID NO: 687159 - DNA, 25 bp, Rattus norvegicus
tttaaccagcgcctcaggagatgct

SEQ ID NO: 687160 - DNA, 25 bp, Rattus norvegicus
tttaaccagcgcgtcaggagatgct

SEQ ID NO: 687161 - DNA, 25 bp, Rattus norvegicus
tttaaccagcttaaagggcacaaca

SEQ ID NO: 687162 - DNA, 25 bp, Rattus norvegicus
tttaaccagctttaagggcacaaca

SEQ ID NO: 687163 - DNA, 25 bp, Rattus norvegicus
tttaaccaggagacgggagccctca

SEQ ID NO: 687164 - DNA, 25 bp, Rattus norvegicus
tttaaccaggagtcgggagccctca

SEQ ID NO: 687165 - DNA, 25 bp, Rattus norvegicus
tttaaccatcatcccctgtttgcaa

SEQ ID NO: 687166 - DNA, 25 bp, Rattus norvegicus
tttaaccatcatgccctgtttgcaa

SEQ ID NO: 687167 - DNA, 25 bp, Rattus norvegicus
tttaacccacttcttgcagcttttg

SEQ ID NO: 687168 - DNA, 25 bp, Rattus norvegicus
tttaacccacttgttgcagcttttg

SEQ ID NO: 687169 - DNA, 25 bp, Rattus norvegicus
tttaaccccaagaccagcaaacagg

SEQ ID NO: 687170 - DNA, 25 bp, Rattus norvegicus
tttaaccccaagtccagcaaacagg

SEQ ID NO: 687171 - DNA, 25 bp, Rattus norvegicus
tttaaccccagcatggatctgcttc

SEQ ID NO: 687172 - DNA, 25 bp, Rattus norvegicus
tttaaccccagcttggatctgcttc

SEQ ID NO: 687173 - DNA, 25 bp, Rattus norvegicus
tttaaccccataagaaacagcactg

SEQ ID NO: 687174 - DNA, 25 bp, Rattus norvegicus
tttaaccccatatgaaacagcactg

SEQ ID NO: 687175 - DNA, 25 bp, Rattus norvegicus
tttaaccccttgactactcagtcct

SEQ ID NO: 687176 - DNA, 25 bp, Rattus norvegicus
tttaaccccttgtctactcagtcct

SEQ ID NO: 687177 - DNA, 25 bp, Rattus norvegicus
tttaaccctagcactgcagaagcag

SEQ ID NO: 687178 - DNA, 25 bp, Rattus norvegicus
tttaaccctagctctgcagaagcag

SEQ ID NO: 687179 - DNA, 25 bp, Rattus norvegicus
tttaaccctcaaaacttggcgcatt

SEQ ID NO: 687180 - DNA, 25 bp, Rattus norvegicus
tttaaccctcaatacttggcgcatt

SEQ ID NO: 687181 - DNA, 25 bp, Rattus norvegicus
tttaaccctcgcagtgccctcattg

SEQ ID NO: 687182 - DNA, 25 bp, Rattus norvegicus
tttaaccctcgctgtgccctcattg

SEQ ID NO: 687183 - DNA, 25 bp, Rattus norvegicus
tttaaccctgggatgcactgtggag

SEQ ID NO: 687184 - DNA, 25 bp, Rattus norvegicus
tttaaccctgggttgcactgtggag

SEQ ID NO: 687185 - DNA, 25 bp, Rattus norvegicus
tttaacccttgtcctttgtgaagca

SEQ ID NO: 687186 - DNA, 25 bp, Rattus norvegicus
tttaacccttgtgctttgtgaagca

SEQ ID NO: 687187 - DNA, 25 bp, Rattus norvegicus
tttaaccgtgctctgtctgaaacat

SEQ ID NO: 687188 - DNA, 25 bp, Rattus norvegicus
tttaaccgtgctgtgtctgaaacat

SEQ ID NO: 687189 - DNA, 25 bp, Rattus norvegicus
tttaacctggagactaacccacaga

SEQ ID NO: 687190 - DNA, 25 bp, Rattus norvegicus
tttaacctggagtctaacccacaga

SEQ ID NO: 687191 - DNA, 25 bp, Rattus norvegicus
tttaaccttaagcacaccacagcat

SEQ ID NO: 687192 - DNA, 25 bp, Rattus norvegicus
tttaaccttaaggacaccacagcat

SEQ ID NO: 687193 - DNA, 25 bp, Rattus norvegicus
tttaaccttacgatccagcagacag

SEQ ID NO: 687194 - DNA, 25 bp, Rattus norvegicus
tttaaccttacgttccagcagacag

SEQ ID NO: 687195 - DNA, 25 bp, Rattus norvegicus
tttaaccttgtcaaaagagctgttt

SEQ ID NO: 687196 - DNA, 25 bp, Rattus norvegicus
tttaaccttgtctaaagagctgttt

SEQ ID NO: 687197 - DNA, 25 bp, Rattus norvegicus
tttaacctttccctgcccacatgga

SEQ ID NO: 687198 - DNA, 25 bp, Rattus norvegicus
tttaacctttccgtgcccacatgga

SEQ ID NO: 687199 - DNA, 25 bp, Rattus norvegicus
tttaacgactttccatggctgatcc

SEQ ID NO: 687200 - DNA, 25 bp, Rattus norvegicus
tttaacgactttgcatggctgatcc

SEQ ID NO: 687201 - DNA, 25 bp, Rattus norvegicus
tttaacgagcgtcgctcctcgctaa

SEQ ID NO: 687202 - DNA, 25 bp, Rattus norvegicus
tttaacgagcgtggctcctcgctaa

SEQ ID NO: 687203 - DNA, 25 bp, Rattus norvegicus
tttaacgagtttcgctcctgggagc

SEQ ID NO: 687204 - DNA, 25 bp, Rattus norvegicus
tttaacgagtttggctcctgggagc

SEQ ID NO: 687205 - DNA, 25 bp, Rattus norvegicus
tttaacgataacacactccatggcc

SEQ ID NO: 687206 - DNA, 25 bp, Rattus norvegicus
tttaacgataactcactccatggcc

SEQ ID NO: 687207 - DNA, 25 bp, Rattus norvegicus
tttaacgtatgtcatccgccatgct

SEQ ID NO: 687208 - DNA, 25 bp, Rattus norvegicus
tttaacgtatgtgatccgccatgct

SEQ ID NO: 687209 - DNA, 25 bp, Rattus norvegicus
tttaacgtcaccagattggcgggag

SEQ ID NO: 687210 - DNA, 25 bp, Rattus norvegicus
tttaacgtcacctgattggcgggag

SEQ ID NO: 687211 - DNA, 25 bp, Rattus norvegicus
tttaacgtccttatagcctatcatc

SEQ ID NO: 687212 - DNA, 25 bp, Rattus norvegicus
tttaacgtccttttagcctatcatc

SEQ ID NO: 687213 - DNA, 25 bp, Rattus norvegicus
tttaactaactccatatgctgccag

SEQ ID NO: 687214 - DNA, 25 bp, Rattus norvegicus
tttaactaactcgatatgctgccag

SEQ ID NO: 687215 - DNA, 25 bp, Rattus norvegicus
tttaactacatcctgcagctgggac

SEQ ID NO: 687216 - DNA, 25 bp, Rattus norvegicus
tttaactacatcgtgcagctgggac

SEQ ID NO: 687217 - DNA, 25 bp, Rattus norvegicus
tttaactcaggtacccagtcttcac

SEQ ID NO: 687218 - DNA, 25 bp, Rattus norvegicus
tttaactcaggttcccagtcttcac

SEQ ID NO: 687219 - DNA, 25 bp, Rattus norvegicus
tttaactccattatagtcagcctcc

SEQ ID NO: 687220 - DNA, 25 bp, Rattus norvegicus
tttaactccattttagtcagcctcc

SEQ ID NO: 687221 - DNA, 25 bp, Rattus norvegicus
tttaactctaacacccttcagaaat

SEQ ID NO: 687222 - DNA, 25 bp, Rattus norvegicus
tttaactctaactcccttcagaaat

SEQ ID NO: 687223 - DNA, 25 bp, Rattus norvegicus
tttaactgacctcactcctcaagaa

SEQ ID NO: 687224 - DNA, 25 bp, Rattus norvegicus
tttaactgacctgactcctcaagaa

SEQ ID NO: 687225 - DNA, 25 bp, Rattus norvegicus
tttaactgactgcttatggcttcgt

SEQ ID NO: 687226 - DNA, 25 bp, Rattus norvegicus
tttaactgactggttatggcttcgt

SEQ ID NO: 687227 - DNA, 25 bp, Rattus norvegicus
tttaactgcaaacggtgaccaattt

SEQ ID NO: 687228 - DNA, 25 bp, Rattus norvegicus
tttaactgcaaagggtgaccaattt

SEQ ID NO: 687229 - DNA, 25 bp, Rattus norvegicus
tttaactgcagacaaaatatcccaa

SEQ ID NO: 687230 - DNA, 25 bp, Rattus norvegicus
tttaactgcagagaaaatatcccaa

SEQ ID NO: 687231 - DNA, 25 bp, Rattus norvegicus
tttaactgctgtcaacccacttggg

SEQ ID NO: 687232 - DNA, 25 bp, Rattus norvegicus
tttaactgctgtgaacccacttggg

SEQ ID NO: 687233 - DNA, 25 bp, Rattus norvegicus
tttaacttcaggctcactgcttttc

SEQ ID NO: 687234 - DNA, 25 bp, Rattus norvegicus
tttaacttcagggtcactgcttttc

SEQ ID NO: 687235 - DNA, 25 bp, Rattus norvegicus
tttaacttccgtcagggctcccgct

SEQ ID NO: 687236 - DNA, 25 bp, Rattus norvegicus
tttaacttccgtgagggctcccgct

SEQ ID NO: 687237 - DNA, 25 bp, Rattus norvegicus
tttaactttgaaatgccggtggcct

SEQ ID NO: 687238 - DNA, 25 bp, Rattus norvegicus
tttaactttgaattgccggtggcct

SEQ ID NO: 687239 - DNA, 25 bp, Rattus norvegicus
tttaacttttttcctcctcctgaag

SEQ ID NO: 687240 - DNA, 25 bp, Rattus norvegicus
tttaacttttttgctcctcctgaag

SEQ ID NO: 687241 - DNA, 25 bp, Rattus norvegicus
tttaagaaagctcccagccctgtcc

SEQ ID NO: 687242 - DNA, 25 bp, Rattus norvegicus
tttaagaaagctgccagccctgtcc

SEQ ID NO: 687243 - DNA, 25 bp, Rattus norvegicus
tttaagaatattccggactggaaac

SEQ ID NO: 687244 - DNA, 25 bp, Rattus norvegicus
tttaagaatattgcggactggaaac

SEQ ID NO: 687245 - DNA, 25 bp, Rattus norvegicus
tttaagaccacaactcagacaccat

SEQ ID NO: 687246 - DNA, 25 bp, Rattus norvegicus
tttaagaccacatctcagacaccat

SEQ ID NO: 687247 - DNA, 25 bp, Rattus norvegicus
tttaagacttgcctccctctggaga

SEQ ID NO: 687248 - DNA, 25 bp, Rattus norvegicus
tttaagacttgcgtccctctggaga

SEQ ID NO: 687249 - DNA, 25 bp, Rattus norvegicus
tttaagagcagcagccacttggcaa

SEQ ID NO: 687250 - DNA, 25 bp, Rattus norvegicus
tttaagagcagctgccacttggcaa

SEQ ID NO: 687251 - DNA, 25 bp, Rattus norvegicus
tttaagagcccgagaaagtgtttct

SEQ ID NO: 687252 - DNA, 25 bp, Rattus norvegicus
tttaagagcccgtgaaagtgtttct

SEQ ID NO: 687253 - DNA, 25 bp, Rattus norvegicus
tttaagagccgtccactgggaaatt

SEQ ID NO: 687254 - DNA, 25 bp, Rattus norvegicus
tttaagagccgtgcactgggaaatt

SEQ ID NO: 687255 - DNA, 25 bp, Rattus norvegicus
tttaagagctgaactcttccacctg

SEQ ID NO: 687256 - DNA, 25 bp, Rattus norvegicus
tttaagagctgatctcttccacctg

SEQ ID NO: 687257 - DNA, 25 bp, Rattus norvegicus
tttaagagggacctgccaccgggct

SEQ ID NO: 687258 - DNA, 25 bp, Rattus norvegicus
tttaagagggacgtgccaccgggct

SEQ ID NO: 687259 - DNA, 25 bp, Rattus norvegicus
tttaagaggtctccaggctgctcaa

SEQ ID NO: 687260 - DNA, 25 bp, Rattus norvegicus
tttaagaggtctgcaggctgctcaa

SEQ ID NO: 687261 - DNA, 25 bp, Rattus norvegicus
tttaagagtcttaccatcgccccag

SEQ ID NO: 687262 - DNA, 25 bp, Rattus norvegicus
tttaagagtctttccatcgccccag

SEQ ID NO: 687263 - DNA, 25 bp, Rattus norvegicus
tttaagataggccatcccatctcac

SEQ ID NO: 687264 - DNA, 25 bp, Rattus norvegicus
tttaagataggcgatcccatctcac

SEQ ID NO: 687265 - DNA, 25 bp, Rattus norvegicus
tttaagatcccgaaagcacttgcag

SEQ ID NO: 687266 - DNA, 25 bp, Rattus norvegicus
tttaagatcccgtaagcacttgcag

SEQ ID NO: 687267 - DNA, 25 bp, Rattus norvegicus
tttaagattactactgttgccctca

SEQ ID NO: 687268 - DNA, 25 bp, Rattus norvegicus
tttaagattacttctgttgccctca

SEQ ID NO: 687269 - DNA, 25 bp, Rattus norvegicus
tttaagcacacgagctcagcaagct

SEQ ID NO: 687270 - DNA, 25 bp, Rattus norvegicus
tttaagcacacgtgctcagcaagct

SEQ ID NO: 687271 - DNA, 25 bp, Rattus norvegicus
tttaagcaggcgattatttctgcag

SEQ ID NO: 687272 - DNA, 25 bp, Rattus norvegicus
tttaagcaggcgtttatttctgcag

SEQ ID NO: 687273 - DNA, 25 bp, Rattus norvegicus
tttaagccaagacccggacactacg

SEQ ID NO: 687274 - DNA, 25 bp, Rattus norvegicus
tttaagccaagagccggacactacg

SEQ ID NO: 687275 - DNA, 25 bp, Rattus norvegicus
tttaagcccttccagaatgtccttg

SEQ ID NO: 687276 - DNA, 25 bp, Rattus norvegicus
tttaagcccttcgagaatgtccttg

SEQ ID NO: 687277 - DNA, 25 bp, Rattus norvegicus
tttaagcctcaacaatgcacatctg

SEQ ID NO: 687278 - DNA, 25 bp, Rattus norvegicus
tttaagcctcaagaatgcacatctg

SEQ ID NO: 687279 - DNA, 25 bp, Rattus norvegicus
tttaagcctctgctactattagtta

SEQ ID NO: 687280 - DNA, 25 bp, Rattus norvegicus
tttaagcctctggtactattagtta

SEQ ID NO: 687281 - DNA, 25 bp, Rattus norvegicus
tttaagcctttgaatgtgtcctcag

SEQ ID NO: 687282 - DNA, 25 bp, Rattus norvegicus
tttaagcctttgtatgtgtcctcag

SEQ ID NO: 687283 - DNA, 25 bp, Rattus norvegicus
tttaagcggataacgggcacttcca

SEQ ID NO: 687284 - DNA, 25 bp, Rattus norvegicus
tttaagcggatatcgggcacttcca

SEQ ID NO: 687285 - DNA, 25 bp, Rattus norvegicus
tttaagctcctgattcttacttccc

SEQ ID NO: 687286 - DNA, 25 bp, Rattus norvegicus
tttaagctcctgtttcttacttccc

SEQ ID NO: 687287 - DNA, 25 bp, Rattus norvegicus
tttaagctctgtcccaatgtcccat

SEQ ID NO: 687288 - DNA, 25 bp, Rattus norvegicus
tttaagctctgtgccaatgtcccat

SEQ ID NO: 687289 - DNA, 25 bp, Rattus norvegicus
tttaagcttccgctagtgccagaca

SEQ ID NO: 687290 - DNA, 25 bp, Rattus norvegicus
tttaagcttccggtagtgccagaca

SEQ ID NO: 687291 - DNA, 25 bp, Rattus norvegicus
tttaagcttggtcctccggctctgg

SEQ ID NO: 687292 - DNA, 25 bp, Rattus norvegicus
tttaagcttggtgctccggctctgg

SEQ ID NO: 687293 - DNA, 25 bp, Rattus norvegicus
tttaaggcaaggactgctggtctcc

SEQ ID NO: 687294 - DNA, 25 bp, Rattus norvegicus
tttaaggcaaggtctgctggtctcc

SEQ ID NO: 687295 - DNA, 25 bp, Rattus norvegicus
tttaaggcagctagttgctcttctg

SEQ ID NO: 687296 - DNA, 25 bp, Rattus norvegicus
tttaaggcagcttgttgctcttctg

SEQ ID NO: 687297 - DNA, 25 bp, Rattus norvegicus
tttaaggccacacagttagcccgca

SEQ ID NO: 687298 - DNA, 25 bp, Rattus norvegicus
tttaaggccacagagttagcccgca

SEQ ID NO: 687299 - DNA, 25 bp, Rattus norvegicus
tttaaggccggaccactgtgagcac

SEQ ID NO: 687300 - DNA, 25 bp, Rattus norvegicus
tttaaggccggagcactgtgagcac

SEQ ID NO: 687301 - DNA, 25 bp, Rattus norvegicus
tttaaggcctatcgatacctccagt

SEQ ID NO: 687302 - DNA, 25 bp, Rattus norvegicus
tttaaggcctatggatacctccagt

SEQ ID NO: 687303 - DNA, 25 bp, Rattus norvegicus
tttaaggcctgtcttcagtcccaaa

SEQ ID NO: 687304 - DNA, 25 bp, Rattus norvegicus
tttaaggcctgtcttgcggatccgc

SEQ ID NO: 687305 - DNA, 25 bp, Rattus norvegicus
tttaaggcctgtgttcagtcccaaa

SEQ ID NO: 687306 - DNA, 25 bp, Rattus norvegicus
tttaaggcctgtgttgcggatccgc

SEQ ID NO: 687307 - DNA, 25 bp, Rattus norvegicus
tttaaggctttaactggctctataa

SEQ ID NO: 687308 - DNA, 25 bp, Rattus norvegicus
tttaaggctttatctggctctataa

SEQ ID NO: 687309 - DNA, 25 bp, Rattus norvegicus
tttaaggcttttcccatggctgggc

SEQ ID NO: 687310 - DNA, 25 bp, Rattus norvegicus
tttaaggcttttgccatggctgggc

SEQ ID NO: 687311 - DNA, 25 bp, Rattus norvegicus
tttaagggacttcgtgtcaccaact

SEQ ID NO: 687312 - DNA, 25 bp, Rattus norvegicus
tttaagggacttggtgtcaccaact

SEQ ID NO: 687313 - DNA, 25 bp, Rattus norvegicus
tttaagggccatctaaacccactgg

SEQ ID NO: 687314 - DNA, 25 bp, Rattus norvegicus
tttaagggccatgtaaacccactgg

SEQ ID NO: 687315 - DNA, 25 bp, Rattus norvegicus
tttaagggcctcactccaagttgtc

SEQ ID NO: 687316 - DNA, 25 bp, Rattus norvegicus
tttaagggcctctctccaagttgtc

SEQ ID NO: 687317 - DNA, 25 bp, Rattus norvegicus
tttaaggtgacccttcagcatgccg

SEQ ID NO: 687318 - DNA, 25 bp, Rattus norvegicus
tttaaggtgaccgttcagcatgccg

SEQ ID NO: 687319 - DNA, 25 bp, Rattus norvegicus
tttaaggttgcacattccccatgcc

SEQ ID NO: 687320 - DNA, 25 bp, Rattus norvegicus
tttaaggttgcagattccccatgcc

SEQ ID NO: 687321 - DNA, 25 bp, Rattus norvegicus
tttaaggttgtgattcttttacatg

SEQ ID NO: 687322 - DNA, 25 bp, Rattus norvegicus
tttaaggttgtgtttcttttacatg

SEQ ID NO: 687323 - DNA, 25 bp, Rattus norvegicus
tttaagtaaccacgtcacccctgct

SEQ ID NO: 687324 - DNA, 25 bp, Rattus norvegicus
tttaagtaaccaggtcacccctgct

SEQ ID NO: 687325 - DNA, 25 bp, Rattus norvegicus
tttaagtcactcagtgtttcctgcc

SEQ ID NO: 687326 - DNA, 25 bp, Rattus norvegicus
tttaagtcactctgtgtttcctgcc

SEQ ID NO: 687327 - DNA, 25 bp, Rattus norvegicus
tttaagtcagcgctcctctgtggac

SEQ ID NO: 687328 - DNA, 25 bp, Rattus norvegicus
tttaagtcagcggtcctctgtggac

SEQ ID NO: 687329 - DNA, 25 bp, Rattus norvegicus
tttaagtctcacagttcaccgttag

SEQ ID NO: 687330 - DNA, 25 bp, Rattus norvegicus
tttaagtctcactgttcaccgttag

SEQ ID NO: 687331 - DNA, 25 bp, Rattus norvegicus
tttaagtcttccctatgctgtctga

SEQ ID NO: 687332 - DNA, 25 bp, Rattus norvegicus
tttaagtcttccgtatgctgtctga

SEQ ID NO: 687333 - DNA, 25 bp, Rattus norvegicus
tttaagtgcttgaggctctctgaag

SEQ ID NO: 687334 - DNA, 25 bp, Rattus norvegicus
tttaagtgcttgtggctctctgaag

SEQ ID NO: 687335 - DNA, 25 bp, Rattus norvegicus
tttaagtgctttccagaatcccctg

SEQ ID NO: 687336 - DNA, 25 bp, Rattus norvegicus
tttaagtgctttgcagaatcccctg

SEQ ID NO: 687337 - DNA, 25 bp, Rattus norvegicus
tttaagtgtatcaggtgagtgggct

SEQ ID NO: 687338 - DNA, 25 bp, Rattus norvegicus
tttaagtgtatctggtgagtgggct

SEQ ID NO: 687339 - DNA, 25 bp, Rattus norvegicus
tttaagtgtggtccagggcgttccc

SEQ ID NO: 687340 - DNA, 25 bp, Rattus norvegicus
tttaagtgtggtgcagggcgttccc

SEQ ID NO: 687341 - DNA, 25 bp, Rattus norvegicus
tttaataatttcaccgcctttcact

SEQ ID NO: 687342 - DNA, 25 bp, Rattus norvegicus
tttaataatttctccgcctttcact

SEQ ID NO: 687343 - DNA, 25 bp, Rattus norvegicus
tttaatacgtgtctcagacgccctt

SEQ ID NO: 687344 - DNA, 25 bp, Rattus norvegicus
tttaatacgtgtgtcagacgccctt

SEQ ID NO: 687345 - DNA, 25 bp, Rattus norvegicus
tttaatagggaaccgctgtcagggt

SEQ ID NO: 687346 - DNA, 25 bp, Rattus norvegicus
tttaatagggaagcgctgtcagggt

SEQ ID NO: 687347 - DNA, 25 bp, Rattus norvegicus
tttaatagttccatttgagttgtga

SEQ ID NO: 687348 - DNA, 25 bp, Rattus norvegicus
tttaatagttccttttgagttgtga

SEQ ID NO: 687349 - DNA, 25 bp, Rattus norvegicus
tttaatatatgtattcccctagagt

SEQ ID NO: 687350 - DNA, 25 bp, Rattus norvegicus
tttaatatatgttttcccctagagt

SEQ ID NO: 687351 - DNA, 25 bp, Rattus norvegicus
tttaatattcggcatttttccaaga

SEQ ID NO: 687352 - DNA, 25 bp, Rattus norvegicus
tttaatattcgggatttttccaaga

SEQ ID NO: 687353 - DNA, 25 bp, Rattus norvegicus
tttaatcactgacggttgctgtcca

SEQ ID NO: 687354 - DNA, 25 bp, Rattus norvegicus
tttaatcactgagggttgctgtcca

SEQ ID NO: 687355 - DNA, 25 bp, Rattus norvegicus
tttaatcatagtctgtgttttggca

SEQ ID NO: 687356 - DNA, 25 bp, Rattus norvegicus
tttaatcatagtgtgtgttttggca

SEQ ID NO: 687357 - DNA, 25 bp, Rattus norvegicus
tttaatcatcacaaccccaaagcag

SEQ ID NO: 687358 - DNA, 25 bp, Rattus norvegicus
tttaatcatcactaccccaaagcag

SEQ ID NO: 687359 - DNA, 25 bp, Rattus norvegicus
tttaatcatcccaagaacctcctgg

SEQ ID NO: 687360 - DNA, 25 bp, Rattus norvegicus
tttaatcatccctagaacctcctgg

SEQ ID NO: 687361 - DNA, 25 bp, Rattus norvegicus
tttaatcatcgtcgaggccctgttt

SEQ ID NO: 687362 - DNA, 25 bp, Rattus norvegicus
tttaatcatcgtggaggccctgttt

SEQ ID NO: 687363 - DNA, 25 bp, Rattus norvegicus
tttaatccaatgaccttagccgtgc

SEQ ID NO: 687364 - DNA, 25 bp, Rattus norvegicus
tttaatccaatgtccttagccgtgc

SEQ ID NO: 687365 - DNA, 25 bp, Rattus norvegicus
tttaatcccaacacagcagagacag

SEQ ID NO: 687366 - DNA, 25 bp, Rattus norvegicus
tttaatcccaactcagcagagacag

SEQ ID NO: 687367 - DNA, 25 bp, Rattus norvegicus
tttaatccctacctaagcctctagg

SEQ ID NO: 687368 - DNA, 25 bp, Rattus norvegicus
tttaatccctacgtaagcctctagg

SEQ ID NO: 687369 - DNA, 25 bp, Rattus norvegicus
tttaatccggctcttctggaagtga

SEQ ID NO: 687370 - DNA, 25 bp, Rattus norvegicus
tttaatccggctgttctggaagtga

SEQ ID NO: 687371 - DNA, 25 bp, Rattus norvegicus
tttaatcctacacctcaacacattt

SEQ ID NO: 687372 - DNA, 25 bp, Rattus norvegicus
tttaatcctacagctcaacacattt

SEQ ID NO: 687373 - DNA, 25 bp, Rattus norvegicus
tttaatcctatgcaaaccacctgag

SEQ ID NO: 687374 - DNA, 25 bp, Rattus norvegicus
tttaatcctatggaaaccacctgag

SEQ ID NO: 687375 - DNA, 25 bp, Rattus norvegicus
tttaatcgacacatcgtgcctcaag

SEQ ID NO: 687376 - DNA, 25 bp, Rattus norvegicus
tttaatcgacacttcgtgcctcaag

SEQ ID NO: 687377 - DNA, 25 bp, Rattus norvegicus
tttaatcgaggtctggaacgggcac

SEQ ID NO: 687378 - DNA, 25 bp, Rattus norvegicus
tttaatcgaggtgtggaacgggcac

SEQ ID NO: 687379 - DNA, 25 bp, Rattus norvegicus
tttaatctaagcctcactattccct

SEQ ID NO: 687380 - DNA, 25 bp, Rattus norvegicus
tttaatctaagcgtcactattccct

SEQ ID NO: 687381 - DNA, 25 bp, Rattus norvegicus
tttaatctagcacagaatagccaag

SEQ ID NO: 687382 - DNA, 25 bp, Rattus norvegicus
tttaatctagcagagaatagccaag

SEQ ID NO: 687383 - DNA, 25 bp, Rattus norvegicus
tttaatctcagaatcgggccagctc

SEQ ID NO: 687384 - DNA, 25 bp, Rattus norvegicus
tttaatctcagattcgggccagctc

SEQ ID NO: 687385 - DNA, 25 bp, Rattus norvegicus
tttaatctcagtccggatcttctcc

SEQ ID NO: 687386 - DNA, 25 bp, Rattus norvegicus
tttaatctcagtgcggatcttctcc

SEQ ID NO: 687387 - DNA, 25 bp, Rattus norvegicus
tttaatctcatcacccagcgggagg

SEQ ID NO: 687388 - DNA, 25 bp, Rattus norvegicus
tttaatctcatctcccagcgggagg

SEQ ID NO: 687389 - DNA, 25 bp, Rattus norvegicus
tttaatctcggtctggttatgccct

SEQ ID NO: 687390 - DNA, 25 bp, Rattus norvegicus
tttaatctcggtgtggttatgccct

SEQ ID NO: 687391 - DNA, 25 bp, Rattus norvegicus
tttaatctctttaatccccatcacc

SEQ ID NO: 687392 - DNA, 25 bp, Rattus norvegicus
tttaatctcttttatccccatcacc

SEQ ID NO: 687393 - DNA, 25 bp, Rattus norvegicus
tttaatctgttaaccttgtctgctt

SEQ ID NO: 687394 - DNA, 25 bp, Rattus norvegicus
tttaatctgttatccttgtctgctt

SEQ ID NO: 687395 - DNA, 25 bp, Rattus norvegicus
tttaatcttctgctccatctctcca

SEQ ID NO: 687396 - DNA, 25 bp, Rattus norvegicus
tttaatcttctggtccatctctcca

SEQ ID NO: 687397 - DNA, 25 bp, Rattus norvegicus
tttaatcttgttcaaaggcccatga

SEQ ID NO: 687398 - DNA, 25 bp, Rattus norvegicus
tttaatcttgttgaaaggcccatga

SEQ ID NO: 687399 - DNA, 25 bp, Rattus norvegicus
tttaatctttctagttgtctgcctc

SEQ ID NO: 687400 - DNA, 25 bp, Rattus norvegicus
tttaatctttcttgttgtctgcctc

SEQ ID NO: 687401 - DNA, 25 bp, Rattus norvegicus
tttaatgagtggcttcctttccttt

SEQ ID NO: 687402 - DNA, 25 bp, Rattus norvegicus
tttaatgagtgggttcctttccttt

SEQ ID NO: 687403 - DNA, 25 bp, Rattus norvegicus
tttaatgcaccacaaagctttttac

SEQ ID NO: 687404 - DNA, 25 bp, Rattus norvegicus
tttaatgcaccagaaagctttttac

SEQ ID NO: 687405 - DNA, 25 bp, Rattus norvegicus
tttaatgcagaacgaccggcaggat

SEQ ID NO: 687406 - DNA, 25 bp, Rattus norvegicus
tttaatgcagaaggaccggcaggat

SEQ ID NO: 687407 - DNA, 25 bp, Rattus norvegicus
tttaatgcctagagaaatccgtttc

SEQ ID NO: 687408 - DNA, 25 bp, Rattus norvegicus
tttaatgcctagtgaaatccgtttc

SEQ ID NO: 687409 - DNA, 25 bp, Rattus norvegicus
tttaatgcctttcgccttcaattct

SEQ ID NO: 687410 - DNA, 25 bp, Rattus norvegicus
tttaatgcctttggccttcaattct

SEQ ID NO: 687411 - DNA, 25 bp, Rattus norvegicus
tttaatgcgggcctgtctacacagt

SEQ ID NO: 687412 - DNA, 25 bp, Rattus norvegicus
tttaatgcgggcgtgtctacacagt

SEQ ID NO: 687413 - DNA, 25 bp, Rattus norvegicus
tttaatgctctaatctgacctccac

SEQ ID NO: 687414 - DNA, 25 bp, Rattus norvegicus
tttaatgctctattctgacctccac

SEQ ID NO: 687415 - DNA, 25 bp, Rattus norvegicus
tttaatgctgccataactgttcggc

SEQ ID NO: 687416 - DNA, 25 bp, Rattus norvegicus
tttaatgctgccttaactgttcggc

SEQ ID NO: 687417 - DNA, 25 bp, Rattus norvegicus
tttaatgctgttagttgtcatgaaa

SEQ ID NO: 687418 - DNA, 25 bp, Rattus norvegicus
tttaatgctgtttgttgtcatgaaa

SEQ ID NO: 687419 - DNA, 25 bp, Rattus norvegicus
tttaatgggacacctcaactggaaa

SEQ ID NO: 687420 - DNA, 25 bp, Rattus norvegicus
tttaatgggacagctcaactggaaa

SEQ ID NO: 687421 - DNA, 25 bp, Rattus norvegicus
tttaatgggcaaacaattggacctt

SEQ ID NO: 687422 - DNA, 25 bp, Rattus norvegicus
tttaatgggcaatcaattggacctt

SEQ ID NO: 687423 - DNA, 25 bp, Rattus norvegicus
tttaatgggcacctttggcatctac

SEQ ID NO: 687424 - DNA, 25 bp, Rattus norvegicus
tttaatgggcacgtttggcatctac

SEQ ID NO: 687425 - DNA, 25 bp, Rattus norvegicus
tttaatgggccacagatgcagccag

SEQ ID NO: 687426 - DNA, 25 bp, Rattus norvegicus
tttaatgggccagagatgcagccag

SEQ ID NO: 687427 - DNA, 25 bp, Rattus norvegicus
tttaatggtctcacactttacgccg

SEQ ID NO: 687428 - DNA, 25 bp, Rattus norvegicus
tttaatggtctctcactttacgccg

SEQ ID NO: 687429 - DNA, 25 bp, Rattus norvegicus
tttaatgtagatcctcgggtttcca

SEQ ID NO: 687430 - DNA, 25 bp, Rattus norvegicus
tttaatgtagatgctcgggtttcca

SEQ ID NO: 687431 - DNA, 25 bp, Rattus norvegicus
tttaatgtccgtagccatggccata

SEQ ID NO: 687432 - DNA, 25 bp, Rattus norvegicus
tttaatgtccgttgccatggccata

SEQ ID NO: 687433 - DNA, 25 bp, Rattus norvegicus
tttaatgtgcagaacacatcagcct

SEQ ID NO: 687434 - DNA, 25 bp, Rattus norvegicus
tttaatgtgcagtacacatcagcct

SEQ ID NO: 687435 - DNA, 25 bp, Rattus norvegicus
tttaatgtggacatggccaaggcct

SEQ ID NO: 687436 - DNA, 25 bp, Rattus norvegicus
tttaatgtggacttggccaaggcct

SEQ ID NO: 687437 - DNA, 25 bp, Rattus norvegicus
tttaattagatactccccatcccca

SEQ ID NO: 687438 - DNA, 25 bp, Rattus norvegicus
tttaattagatagtccccatcccca

SEQ ID NO: 687439 - DNA, 25 bp, Rattus norvegicus
tttaattagccaattctgtcatagg

SEQ ID NO: 687440 - DNA, 25 bp, Rattus norvegicus
tttaattagccacacatcaacgatg

SEQ ID NO: 687441 - DNA, 25 bp, Rattus norvegicus
tttaattagccagacatcaacgatg

SEQ ID NO: 687442 - DNA, 25 bp, Rattus norvegicus
tttaattagccatttctgtcatagg

SEQ ID NO: 687443 - DNA, 25 bp, Rattus norvegicus
tttaattcatccctttgactaccct

SEQ ID NO: 687444 - DNA, 25 bp, Rattus norvegicus
tttaattcatccgtttgactaccct

SEQ ID NO: 687445 - DNA, 25 bp, Rattus norvegicus
tttaattccaacactcaaagaggta

SEQ ID NO: 687446 - DNA, 25 bp, Rattus norvegicus
tttaattccaactctcaaagaggta

SEQ ID NO: 687447 - DNA, 25 bp, Rattus norvegicus
tttaattcccagaacccaggtctgc

SEQ ID NO: 687448 - DNA, 25 bp, Rattus norvegicus
tttaattcccagtacccaggtctgc

SEQ ID NO: 687449 - DNA, 25 bp, Rattus norvegicus
tttaattctgaaaggactgccttcc

SEQ ID NO: 687450 - DNA, 25 bp, Rattus norvegicus
tttaattctgaatggactgccttcc

SEQ ID NO: 687451 - DNA, 25 bp, Rattus norvegicus
tttaattggcagaaatacgtcccca

SEQ ID NO: 687452 - DNA, 25 bp, Rattus norvegicus
tttaattggcagtaatacgtcccca

SEQ ID NO: 687453 - DNA, 25 bp, Rattus norvegicus
tttaattggtggacactggcatagt

SEQ ID NO: 687454 - DNA, 25 bp, Rattus norvegicus
tttaattggtggtcactggcatagt

SEQ ID NO: 687455 - DNA, 25 bp, Rattus norvegicus
tttaattgtttgcacacaccccagc

SEQ ID NO: 687456 - DNA, 25 bp, Rattus norvegicus
tttaattgtttggacacaccccagc

SEQ ID NO: 687457 - DNA, 25 bp, Rattus norvegicus
tttaatttacttaccacattggcag

SEQ ID NO: 687458 - DNA, 25 bp, Rattus norvegicus
tttaatttactttccacattggcag

SEQ ID NO: 687459 - DNA, 25 bp, Rattus norvegicus
tttaatttcgatacagctggtctgg

SEQ ID NO: 687460 - DNA, 25 bp, Rattus norvegicus
tttaatttcgattcagctggtctgg

SEQ ID NO: 687461 - DNA, 25 bp, Rattus norvegicus
tttaatttcgggagagcagcactca

SEQ ID NO: 687462 - DNA, 25 bp, Rattus norvegicus
tttaatttcgggtgagcagcactca

SEQ ID NO: 687463 - DNA, 25 bp, Rattus norvegicus
tttaatttctagacctccactctac

SEQ ID NO: 687464 - DNA, 25 bp, Rattus norvegicus
tttaatttctagagcccaggtgggt

SEQ ID NO: 687465 - DNA, 25 bp, Rattus norvegicus
tttaatttctagtcctccactctac

SEQ ID NO: 687466 - DNA, 25 bp, Rattus norvegicus
tttaatttctagtgcccaggtgggt

SEQ ID NO: 687467 - DNA, 25 bp, Rattus norvegicus
tttaatttctttctcctcagataag

SEQ ID NO: 687468 - DNA, 25 bp, Rattus norvegicus
tttaatttctttgtcctcagataag

SEQ ID NO: 687469 - DNA, 25 bp, Rattus norvegicus
tttaatttgctcctgtgtgctgtct

SEQ ID NO: 687470 - DNA, 25 bp, Rattus norvegicus
tttaatttgctcgtgtgtgctgtct

SEQ ID NO: 687471 - DNA, 25 bp, Rattus norvegicus
tttaattttaaccagagcaagcttt

SEQ ID NO: 687472 - DNA, 25 bp, Rattus norvegicus
tttaattttaacgagagcaagcttt

SEQ ID NO: 687473 - DNA, 25 bp, Rattus norvegicus
tttaattttcccatttgtaccatat

SEQ ID NO: 687474 - DNA, 25 bp, Rattus norvegicus
tttaattttcccttttgtaccatat

SEQ ID NO: 687475 - DNA, 25 bp, Rattus norvegicus
tttacaaagcacacctacgtgggtt

SEQ ID NO: 687476 - DNA, 25 bp, Rattus norvegicus
tttacaaagcactcctacgtgggtt

SEQ ID NO: 687477 - DNA, 25 bp, Rattus norvegicus
tttacaaagcttcctcactgcatgg

SEQ ID NO: 687478 - DNA, 25 bp, Rattus norvegicus
tttacaaagcttgctcactgcatgg

SEQ ID NO: 687479 - DNA, 25 bp, Rattus norvegicus
tttacaacaagtacagtcatgacac

SEQ ID NO: 687480 - DNA, 25 bp, Rattus norvegicus
tttacaacaagttcagtcatgacac

SEQ ID NO: 687481 - DNA, 25 bp, Rattus norvegicus
tttacaacacatactttcttaagag

SEQ ID NO: 687482 - DNA, 25 bp, Rattus norvegicus
tttacaacacattctttcttaagag

SEQ ID NO: 687483 - DNA, 25 bp, Rattus norvegicus
tttacaacaccactgttccttattc

SEQ ID NO: 687484 - DNA, 25 bp, Rattus norvegicus
tttacaacaccagtgttccttattc

SEQ ID NO: 687485 - DNA, 25 bp, Rattus norvegicus
tttacaacacgcacagtgctgacac

SEQ ID NO: 687486 - DNA, 25 bp, Rattus norvegicus
tttacaacacgctcagtgctgacac

SEQ ID NO: 687487 - DNA, 25 bp, Rattus norvegicus
tttacaacaggcctttgggcgcctt

SEQ ID NO: 687488 - DNA, 25 bp, Rattus norvegicus
tttacaacaggcgtttgggcgcctt

SEQ ID NO: 687489 - DNA, 25 bp, Rattus norvegicus
tttacaactacaaaggcctcctaag

SEQ ID NO: 687490 - DNA, 25 bp, Rattus norvegicus
tttacaactacataggcctcctaag

SEQ ID NO: 687491 - DNA, 25 bp, Rattus norvegicus
tttacaactccaactacattggctc

SEQ ID NO: 687492 - DNA, 25 bp, Rattus norvegicus
tttacaactccatctacattggctc

SEQ ID NO: 687493 - DNA, 25 bp, Rattus norvegicus
tttacaagacttctatcccctctgc

SEQ ID NO: 687494 - DNA, 25 bp, Rattus norvegicus
tttacaagacttgtatcccctctgc

SEQ ID NO: 687495 - DNA, 25 bp, Rattus norvegicus
tttacaagccataggagatcccctc

SEQ ID NO: 687496 - DNA, 25 bp, Rattus norvegicus
tttacaagccattggagatcccctc

SEQ ID NO: 687497 - DNA, 25 bp, Rattus norvegicus
tttacaaggacgaccgctttcttgc

SEQ ID NO: 687498 - DNA, 25 bp, Rattus norvegicus
tttacaaggacgtccgctttcttgc

SEQ ID NO: 687499 - DNA, 25 bp, Rattus norvegicus
tttacaaggcagactctggcttcca

SEQ ID NO: 687500 - DNA, 25 bp, Rattus norvegicus
tttacaaggcagtctctggcttcca

SEQ ID NO: 687501 - DNA, 25 bp, Rattus norvegicus
tttacaagtgtcctgtgcgactcca

SEQ ID NO: 687502 - DNA, 25 bp, Rattus norvegicus
tttacaagtgtcgtgtgcgactcca

SEQ ID NO: 687503 - DNA, 25 bp, Rattus norvegicus
tttacaatagtaaccagccaggcca

SEQ ID NO: 687504 - DNA, 25 bp, Rattus norvegicus
tttacaatagtatccagccaggcca

SEQ ID NO: 687505 - DNA, 25 bp, Rattus norvegicus
tttacaatctctctcaatcgtctga

SEQ ID NO: 687506 - DNA, 25 bp, Rattus norvegicus
tttacaatctctgtcaatcgtctga

SEQ ID NO: 687507 - DNA, 25 bp, Rattus norvegicus
tttacaatgtacagaggctctccag

SEQ ID NO: 687508 - DNA, 25 bp, Rattus norvegicus
tttacaatgtactgaggctctccag

SEQ ID NO: 687509 - DNA, 25 bp, Rattus norvegicus
tttacaatttagactgccctttccg

SEQ ID NO: 687510 - DNA, 25 bp, Rattus norvegicus
tttacaatttagtctgccctttccg

SEQ ID NO: 687511 - DNA, 25 bp, Rattus norvegicus
tttacaatttccaagaggagcatgg

SEQ ID NO: 687512 - DNA, 25 bp, Rattus norvegicus
tttacaatttcctagaggagcatgg

SEQ ID NO: 687513 - DNA, 25 bp, Rattus norvegicus
tttacacagctaccgcctctgtgag

SEQ ID NO: 687514 - DNA, 25 bp, Rattus norvegicus
tttacacagctagcgcctctgtgag

SEQ ID NO: 687515 - DNA, 25 bp, Rattus norvegicus
tttacacatggaccatctcctcagc

SEQ ID NO: 687516 - DNA, 25 bp, Rattus norvegicus
tttacacatggagcatctcctcagc

SEQ ID NO: 687517 - DNA, 25 bp, Rattus norvegicus
tttacaccacatactcatctctgat

SEQ ID NO: 687518 - DNA, 25 bp, Rattus norvegicus
tttacaccacattctcatctctgat

SEQ ID NO: 687519 - DNA, 25 bp, Rattus norvegicus
tttacaccacgaacatcatggagca

SEQ ID NO: 687520 - DNA, 25 bp, Rattus norvegicus
tttacaccacgatcatcatggagca

SEQ ID NO: 687521 - DNA, 25 bp, Rattus norvegicus
tttacaccagcccattaatactcct

SEQ ID NO: 687522 - DNA, 25 bp, Rattus norvegicus
tttacaccagccgattaatactcct

SEQ ID NO: 687523 - DNA, 25 bp, Rattus norvegicus
tttacaccatccaaagttctgccat

SEQ ID NO: 687524 - DNA, 25 bp, Rattus norvegicus
tttacaccatcctaagttctgccat

SEQ ID NO: 687525 - DNA, 25 bp, Rattus norvegicus
tttacaccggccagagcctacagag

SEQ ID NO: 687526 - DNA, 25 bp, Rattus norvegicus
tttacaccggcctgagcctacagag

SEQ ID NO: 687527 - DNA, 25 bp, Rattus norvegicus
tttacaccttttcaagtgtcccctg

SEQ ID NO: 687528 - DNA, 25 bp, Rattus norvegicus
tttacaccttttgaagtgtcccctg

SEQ ID NO: 687529 - DNA, 25 bp, Rattus norvegicus
tttacacgtaggcagttgggctttt

SEQ ID NO: 687530 - DNA, 25 bp, Rattus norvegicus
tttacacgtagggagttgggctttt

SEQ ID NO: 687531 - DNA, 25 bp, Rattus norvegicus
tttacacgtgtgagggaccctctga

SEQ ID NO: 687532 - DNA, 25 bp, Rattus norvegicus
tttacacgtgtgtgggaccctctga

SEQ ID NO: 687533 - DNA, 25 bp, Rattus norvegicus
tttacactcggacttctgcggactc

SEQ ID NO: 687534 - DNA, 25 bp, Rattus norvegicus
tttacactcggagttctgcggactc

SEQ ID NO: 687535 - DNA, 25 bp, Rattus norvegicus
tttacacttcccacagctaggtcta

SEQ ID NO: 687536 - DNA, 25 bp, Rattus norvegicus
tttacacttccctcagctaggtcta

SEQ ID NO: 687537 - DNA, 25 bp, Rattus norvegicus
tttacacttgcaaatccaaagattt

SEQ ID NO: 687538 - DNA, 25 bp, Rattus norvegicus
tttacacttgcatatccaaagattt

SEQ ID NO: 687539 - DNA, 25 bp, Rattus norvegicus
tttacagacactcgcatcatccgac

SEQ ID NO: 687540 - DNA, 25 bp, Rattus norvegicus
tttacagacactggcatcatccgac

SEQ ID NO: 687541 - DNA, 25 bp, Rattus norvegicus
tttacagactctcctctatgtcgtg

SEQ ID NO: 687542 - DNA, 25 bp, Rattus norvegicus
tttacagactctctcctgtggccag

SEQ ID NO: 687543 - DNA, 25 bp, Rattus norvegicus
tttacagactctgctctatgtcgtg

SEQ ID NO: 687544 - DNA, 25 bp, Rattus norvegicus
tttacagactctgtcctgtggccag

SEQ ID NO: 687545 - DNA, 25 bp, Rattus norvegicus
tttacagactggaaagatctcccaa

SEQ ID NO: 687546 - DNA, 25 bp, Rattus norvegicus
tttacagactggtaagatctcccaa

SEQ ID NO: 687547 - DNA, 25 bp, Rattus norvegicus
tttacagagctgagtttcccataac

SEQ ID NO: 687548 - DNA, 25 bp, Rattus norvegicus
tttacagagctgtgtttcccataac

SEQ ID NO: 687549 - DNA, 25 bp, Rattus norvegicus
tttacagaggaacgtctgcacagct

SEQ ID NO: 687550 - DNA, 25 bp, Rattus norvegicus
tttacagaggaaggtctgcacagct

SEQ ID NO: 687551 - DNA, 25 bp, Rattus norvegicus
tttacagagggccttgctgttacct

SEQ ID NO: 687552 - DNA, 25 bp, Rattus norvegicus
tttacagagggcgttgctgttacct

SEQ ID NO: 687553 - DNA, 25 bp, Rattus norvegicus
tttacagatctgatgtgcgtgagct

SEQ ID NO: 687554 - DNA, 25 bp, Rattus norvegicus
tttacagatctgttgtgcgtgagct

SEQ ID NO: 687555 - DNA, 25 bp, Rattus norvegicus
tttacagatggcactggcagagtta

SEQ ID NO: 687556 - DNA, 25 bp, Rattus norvegicus
tttacagatggctctggcagagtta

SEQ ID NO: 687557 - DNA, 25 bp, Rattus norvegicus
tttacagcagccaaactactcttct

SEQ ID NO: 687558 - DNA, 25 bp, Rattus norvegicus
tttacagcagcctaactactcttct

SEQ ID NO: 687559 - DNA, 25 bp, Rattus norvegicus
tttacagccatgaaaaagcctttga

SEQ ID NO: 687560 - DNA, 25 bp, Rattus norvegicus
tttacagccatgtaaaagcctttga

SEQ ID NO: 687561 - DNA, 25 bp, Rattus norvegicus
tttacagcctcacttctgcattgga

SEQ ID NO: 687562 - DNA, 25 bp, Rattus norvegicus
tttacagcctcagttctgcattgga

SEQ ID NO: 687563 - DNA, 25 bp, Rattus norvegicus
tttacagcggccacagaaaactagt

SEQ ID NO: 687564 - DNA, 25 bp, Rattus norvegicus
tttacagcggcctcagaaaactagt

SEQ ID NO: 687565 - DNA, 25 bp, Rattus norvegicus
tttacaggaacccaaccagacgtca

SEQ ID NO: 687566 - DNA, 25 bp, Rattus norvegicus
tttacaggaaccgaaccagacgtca

SEQ ID NO: 687567 - DNA, 25 bp, Rattus norvegicus
tttacaggatcaaccttccctccat

SEQ ID NO: 687568 - DNA, 25 bp, Rattus norvegicus
tttacaggatcatccttccctccat

SEQ ID NO: 687569 - DNA, 25 bp, Rattus norvegicus
tttacaggcaggaggctaccttcct

SEQ ID NO: 687570 - DNA, 25 bp, Rattus norvegicus
tttacaggcaggtggctaccttcct

SEQ ID NO: 687571 - DNA, 25 bp, Rattus norvegicus
tttacaggcgttccccaaggctcag

SEQ ID NO: 687572 - DNA, 25 bp, Rattus norvegicus
tttacaggcgttgcccaaggctcag

SEQ ID NO: 687573 - DNA, 25 bp, Rattus norvegicus
tttacaggtgcactcaccgaaagag

SEQ ID NO: 687574 - DNA, 25 bp, Rattus norvegicus
tttacaggtgcagtcaccgaaagag

SEQ ID NO: 687575 - DNA, 25 bp, Rattus norvegicus
tttacaggttcacttgcttgtccct

SEQ ID NO: 687576 - DNA, 25 bp, Rattus norvegicus
tttacaggttcagttgcttgtccct

SEQ ID NO: 687577 - DNA, 25 bp, Rattus norvegicus
tttacagtactgcaatcaaacccgg

SEQ ID NO: 687578 - DNA, 25 bp, Rattus norvegicus
tttacagtactggaatcaaacccgg

SEQ ID NO: 687579 - DNA, 25 bp, Rattus norvegicus
tttacagtctcgattgttctccagg

SEQ ID NO: 687580 - DNA, 25 bp, Rattus norvegicus
tttacagtctcgtttgttctccagg

SEQ ID NO: 687581 - DNA, 25 bp, Rattus norvegicus
tttacagtgagaacctggtcagttc

SEQ ID NO: 687582 - DNA, 25 bp, Rattus norvegicus
tttacagtgagatcctggtcagttc

SEQ ID NO: 687583 - DNA, 25 bp, Rattus norvegicus
tttacagttctgctctcgttgcctt

SEQ ID NO: 687584 - DNA, 25 bp, Rattus norvegicus
tttacagttctggtctcgttgcctt

SEQ ID NO: 687585 - DNA, 25 bp, Rattus norvegicus
tttacagtttcgctgacagctcatc

SEQ ID NO: 687586 - DNA, 25 bp, Rattus norvegicus
tttacagtttcggtgacagctcatc

SEQ ID NO: 687587 - DNA, 25 bp, Rattus norvegicus
tttacataccctcccaatgccatag

SEQ ID NO: 687588 - DNA, 25 bp, Rattus norvegicus
tttacataccctgccaatgccatag

SEQ ID NO: 687589 - DNA, 25 bp, Rattus norvegicus
tttacatacttgcttttgtctcatt

SEQ ID NO: 687590 - DNA, 25 bp, Rattus norvegicus
tttacatacttggttttgtctcatt

SEQ ID NO: 687591 - DNA, 25 bp, Rattus norvegicus
tttacatattgcatagcaccccatg

SEQ ID NO: 687592 - DNA, 25 bp, Rattus norvegicus
tttacatattgcttagcaccccatg

SEQ ID NO: 687593 - DNA, 25 bp, Rattus norvegicus
tttacatccaggcacagtcttgtct

SEQ ID NO: 687594 - DNA, 25 bp, Rattus norvegicus
tttacatccagggacagtcttgtct

SEQ ID NO: 687595 - DNA, 25 bp, Rattus norvegicus
tttacatccattagtccatctgtct

SEQ ID NO: 687596 - DNA, 25 bp, Rattus norvegicus
tttacatccatttgtccatctgtct

SEQ ID NO: 687597 - DNA, 25 bp, Rattus norvegicus
tttacatccctcagagcttcgagaa

SEQ ID NO: 687598 - DNA, 25 bp, Rattus norvegicus
tttacatccctctgagcttcgagaa

SEQ ID NO: 687599 - DNA, 25 bp, Rattus norvegicus
tttacatcctacatactgttccaat

SEQ ID NO: 687600 - DNA, 25 bp, Rattus norvegicus
tttacatcctacttactgttccaat

SEQ ID NO: 687601 - DNA, 25 bp, Rattus norvegicus
tttacatcctccataactggttggg

SEQ ID NO: 687602 - DNA, 25 bp, Rattus norvegicus
tttacatcctccttaactggttggg

SEQ ID NO: 687603 - DNA, 25 bp, Rattus norvegicus
tttacatcctgccaatcgatctctt

SEQ ID NO: 687604 - DNA, 25 bp, Rattus norvegicus
tttacatcctgcgaatcgatctctt

SEQ ID NO: 687605 - DNA, 25 bp, Rattus norvegicus
tttacatctgcaaaacactctgacg

SEQ ID NO: 687606 - DNA, 25 bp, Rattus norvegicus
tttacatctgcataacactctgacg

SEQ ID NO: 687607 - DNA, 25 bp, Rattus norvegicus
tttacatctgctccctggaaactgg

SEQ ID NO: 687608 - DNA, 25 bp, Rattus norvegicus
tttacatctgctgcctggaaactgg

SEQ ID NO: 687609 - DNA, 25 bp, Rattus norvegicus
tttacatctgggacctgtgtaccca

SEQ ID NO: 687610 - DNA, 25 bp, Rattus norvegicus
tttacatctgggtcctgtgtaccca

SEQ ID NO: 687611 - DNA, 25 bp, Rattus norvegicus
tttacatgaaaaatcactagccatt

SEQ ID NO: 687612 - DNA, 25 bp, Rattus norvegicus
tttacatgaaaattcactagccatt

SEQ ID NO: 687613 - DNA, 25 bp, Rattus norvegicus
tttacatgcaccacctaaggcacag

SEQ ID NO: 687614 - DNA, 25 bp, Rattus norvegicus
tttacatgcacctcctaaggcacag

SEQ ID NO: 687615 - DNA, 25 bp, Rattus norvegicus
tttacatgccctctgtccttctggt

SEQ ID NO: 687616 - DNA, 25 bp, Rattus norvegicus
tttacatgccctgtgtccttctggt

SEQ ID NO: 687617 - DNA, 25 bp, Rattus norvegicus
tttacatggatcactttaaaggtcc

SEQ ID NO: 687618 - DNA, 25 bp, Rattus norvegicus
tttacatggatctctttaaaggtcc

SEQ ID NO: 687619 - DNA, 25 bp, Rattus norvegicus
tttacatggccgagcagcctgggca

SEQ ID NO: 687620 - DNA, 25 bp, Rattus norvegicus
tttacatggccgtgcagcctgggca

SEQ ID NO: 687621 - DNA, 25 bp, Rattus norvegicus
tttacattacatcacaaaagccatc

SEQ ID NO: 687622 - DNA, 25 bp, Rattus norvegicus
tttacattacatgacaaaagccatc

SEQ ID NO: 687623 - DNA, 25 bp, Rattus norvegicus
tttacattatttcgcactcctctca

SEQ ID NO: 687624 - DNA, 25 bp, Rattus norvegicus
tttacattatttggcactcctctca

SEQ ID NO: 687625 - DNA, 25 bp, Rattus norvegicus
tttacattcatacccaagccgaaga

SEQ ID NO: 687626 - DNA, 25 bp, Rattus norvegicus
tttacattcatagccaagccgaaga

SEQ ID NO: 687627 - DNA, 25 bp, Rattus norvegicus
tttacattcccgacttactaaagat

SEQ ID NO: 687628 - DNA, 25 bp, Rattus norvegicus
tttacattcccgtcttactaaagat

SEQ ID NO: 687629 - DNA, 25 bp, Rattus norvegicus
tttacattctaaagtgcatacaagt

SEQ ID NO: 687630 - DNA, 25 bp, Rattus norvegicus
tttacattctaatgtgcatacaagt

SEQ ID NO: 687631 - DNA, 25 bp, Rattus norvegicus
tttacattgggaaccctcgcattac

SEQ ID NO: 687632 - DNA, 25 bp, Rattus norvegicus
tttacattgggatccctcgcattac

SEQ ID NO: 687633 - DNA, 25 bp, Rattus norvegicus
tttacatttaatattggctatcagg

SEQ ID NO: 687634 - DNA, 25 bp, Rattus norvegicus
tttacatttaattttggctatcagg

SEQ ID NO: 687635 - DNA, 25 bp, Rattus norvegicus
tttacattttgcctcctgacaaaaa

SEQ ID NO: 687636 - DNA, 25 bp, Rattus norvegicus
tttacattttgcgtcctgacaaaaa

SEQ ID NO: 687637 - DNA, 25 bp, Rattus norvegicus
tttacatttttgatcctggattcag

SEQ ID NO: 687638 - DNA, 25 bp, Rattus norvegicus
tttacatttttgttcctggattcag

SEQ ID NO: 687639 - DNA, 25 bp, Rattus norvegicus
tttaccaactatattgccacatttg

SEQ ID NO: 687640 - DNA, 25 bp, Rattus norvegicus
tttaccaactattttgccacatttg

SEQ ID NO: 687641 - DNA, 25 bp, Rattus norvegicus
tttaccaaggagacaatcctgagct

SEQ ID NO: 687642 - DNA, 25 bp, Rattus norvegicus
tttaccaaggagtcaatcctgagct

SEQ ID NO: 687643 - DNA, 25 bp, Rattus norvegicus
tttaccaatcatcccacacaagcgt

SEQ ID NO: 687644 - DNA, 25 bp, Rattus norvegicus
tttaccaatcatgccacacaagcgt

SEQ ID NO: 687645 - DNA, 25 bp, Rattus norvegicus
tttaccacatgtcctagcgatgccc

SEQ ID NO: 687646 - DNA, 25 bp, Rattus norvegicus
tttaccacatgtgctagcgatgccc

SEQ ID NO: 687647 - DNA, 25 bp, Rattus norvegicus
tttaccaccgggagtcttggtgcgt

SEQ ID NO: 687648 - DNA, 25 bp, Rattus norvegicus
tttaccaccgggtgtcttggtgcgt

SEQ ID NO: 687649 - DNA, 25 bp, Rattus norvegicus
tttaccactccacaatgacccggag

SEQ ID NO: 687650 - DNA, 25 bp, Rattus norvegicus
tttaccactccagaatgacccggag

SEQ ID NO: 687651 - DNA, 25 bp, Rattus norvegicus
tttaccacttcgagatgccaggcag

SEQ ID NO: 687652 - DNA, 25 bp, Rattus norvegicus
tttaccacttcgtgatgccaggcag

SEQ ID NO: 687653 - DNA, 25 bp, Rattus norvegicus
tttaccagaaggctacagccccatc

SEQ ID NO: 687654 - DNA, 25 bp, Rattus norvegicus
tttaccagaagggtacagccccatc

SEQ ID NO: 687655 - DNA, 25 bp, Rattus norvegicus
tttaccagagaactacgcactttgt

SEQ ID NO: 687656 - DNA, 25 bp, Rattus norvegicus
tttaccagagaagtacgcactttgt

SEQ ID NO: 687657 - DNA, 25 bp, Rattus norvegicus
tttaccagagataagcagatgcctt

SEQ ID NO: 687658 - DNA, 25 bp, Rattus norvegicus
tttaccagagattagcagatgcctt

SEQ ID NO: 687659 - DNA, 25 bp, Rattus norvegicus
tttaccagaggtcacaccggcccaa

SEQ ID NO: 687660 - DNA, 25 bp, Rattus norvegicus
tttaccagaggtgacaccggcccaa

SEQ ID NO: 687661 - DNA, 25 bp, Rattus norvegicus
tttaccagggccaacaatgctccaa

SEQ ID NO: 687662 - DNA, 25 bp, Rattus norvegicus
tttaccagggcctacaatgctccaa

SEQ ID NO: 687663 - DNA, 25 bp, Rattus norvegicus
tttaccatagcacacattggcaatg

SEQ ID NO: 687664 - DNA, 25 bp, Rattus norvegicus
tttaccatagcagacattggcaatg

SEQ ID NO: 687665 - DNA, 25 bp, Rattus norvegicus
tttaccatccatctggtcaggtctc

SEQ ID NO: 687666 - DNA, 25 bp, Rattus norvegicus
tttaccatccatgtggtcaggtctc

SEQ ID NO: 687667 - DNA, 25 bp, Rattus norvegicus
tttaccatcccaactgacttcatct

SEQ ID NO: 687668 - DNA, 25 bp, Rattus norvegicus
tttaccatcccatctgacttcatct

SEQ ID NO: 687669 - DNA, 25 bp, Rattus norvegicus
tttaccatcgtcaatttcagtcacc

SEQ ID NO: 687670 - DNA, 25 bp, Rattus norvegicus
tttaccatcgtctatttcagtcacc

SEQ ID NO: 687671 - DNA, 25 bp, Rattus norvegicus
tttaccatctctctggtggtgacca

SEQ ID NO: 687672 - DNA, 25 bp, Rattus norvegicus
tttaccatctctgtggtggtgacca

SEQ ID NO: 687673 - DNA, 25 bp, Rattus norvegicus
tttaccatctgtcatatccaccttc

SEQ ID NO: 687674 - DNA, 25 bp, Rattus norvegicus
tttaccatctgtgatatccaccttc

SEQ ID NO: 687675 - DNA, 25 bp, Rattus norvegicus
tttaccattatgacctcatttcctg

SEQ ID NO: 687676 - DNA, 25 bp, Rattus norvegicus
tttaccattatgtcctcatttcctg

SEQ ID NO: 687677 - DNA, 25 bp, Rattus norvegicus
tttaccatttccattgttctctcaa

SEQ ID NO: 687678 - DNA, 25 bp, Rattus norvegicus
tttaccatttcctttgttctctcaa

SEQ ID NO: 687679 - DNA, 25 bp, Rattus norvegicus
tttaccatttttccctttgacccag

SEQ ID NO: 687680 - DNA, 25 bp, Rattus norvegicus
tttaccatttttgcctttgacccag

SEQ ID NO: 687681 - DNA, 25 bp, Rattus norvegicus
tttacccaaagaactcaagccttag

SEQ ID NO: 687682 - DNA, 25 bp, Rattus norvegicus
tttacccaaagatctcaagccttag

SEQ ID NO: 687683 - DNA, 25 bp, Rattus norvegicus
tttacccaatgacccgtttcctaag

SEQ ID NO: 687684 - DNA, 25 bp, Rattus norvegicus
tttacccaatgagccgtttcctaag

SEQ ID NO: 687685 - DNA, 25 bp, Rattus norvegicus
tttacccaccatacacttgcaagtt

SEQ ID NO: 687686 - DNA, 25 bp, Rattus norvegicus
tttacccaccattcacttgcaagtt

SEQ ID NO: 687687 - DNA, 25 bp, Rattus norvegicus
tttacccagaccagtggacccagag

SEQ ID NO: 687688 - DNA, 25 bp, Rattus norvegicus
tttacccagacctgtggacccagag

SEQ ID NO: 687689 - DNA, 25 bp, Rattus norvegicus
tttacccagctcacatggtttattg

SEQ ID NO: 687690 - DNA, 25 bp, Rattus norvegicus
tttacccagctctcatggtttattg

SEQ ID NO: 687691 - DNA, 25 bp, Rattus norvegicus
tttacccagggcactggaaggacac

SEQ ID NO: 687692 - DNA, 25 bp, Rattus norvegicus
tttacccagggctctggaaggacac

SEQ ID NO: 687693 - DNA, 25 bp, Rattus norvegicus
tttacccagtacacaaaccacatgt

SEQ ID NO: 687694 - DNA, 25 bp, Rattus norvegicus
tttacccagtactcaaaccacatgt

SEQ ID NO: 687695 - DNA, 25 bp, Rattus norvegicus
tttacccagtatagtcaccatagag

SEQ ID NO: 687696 - DNA, 25 bp, Rattus norvegicus
tttacccagtattgtcaccatagag

SEQ ID NO: 687697 - DNA, 25 bp, Rattus norvegicus
tttacccatggtctctataacttgt

SEQ ID NO: 687698 - DNA, 25 bp, Rattus norvegicus
tttacccatggtgtctataacttgt

SEQ ID NO: 687699 - DNA, 25 bp, Rattus norvegicus
tttaccccaagcagaaaccaggcat

SEQ ID NO: 687700 - DNA, 25 bp, Rattus norvegicus
tttaccccaagctgaaaccaggcat

SEQ ID NO: 687701 - DNA, 25 bp, Rattus norvegicus
tttaccccactgaaacatcctgtaa

SEQ ID NO: 687702 - DNA, 25 bp, Rattus norvegicus
tttaccccactgtaacatcctgtaa

SEQ ID NO: 687703 - DNA, 25 bp, Rattus norvegicus
tttaccccagatcaggtgaccgtga

SEQ ID NO: 687704 - DNA, 25 bp, Rattus norvegicus
tttaccccagatgaggtgaccgtga

SEQ ID NO: 687705 - DNA, 25 bp, Rattus norvegicus
tttaccccataaagttagtcagtca

SEQ ID NO: 687706 - DNA, 25 bp, Rattus norvegicus
tttaccccataatgttagtcagtca

SEQ ID NO: 687707 - DNA, 25 bp, Rattus norvegicus
tttacccctcatcttccattttgaa

SEQ ID NO: 687708 - DNA, 25 bp, Rattus norvegicus
tttacccctcatgttccattttgaa

SEQ ID NO: 687709 - DNA, 25 bp, Rattus norvegicus
tttacccctgagacttggctcagag

SEQ ID NO: 687710 - DNA, 25 bp, Rattus norvegicus
tttacccctgagtcttggctcagag

SEQ ID NO: 687711 - DNA, 25 bp, Rattus norvegicus
tttacccctgtccagtttcattaca

SEQ ID NO: 687712 - DNA, 25 bp, Rattus norvegicus
tttacccctgtcgagtttcattaca

SEQ ID NO: 687713 - DNA, 25 bp, Rattus norvegicus
tttacccgctggatcatctgaacac

SEQ ID NO: 687714 - DNA, 25 bp, Rattus norvegicus
tttacccgctggttcatctgaacac

SEQ ID NO: 687715 - DNA, 25 bp, Rattus norvegicus
tttaccctacctatgacactgactg

SEQ ID NO: 687716 - DNA, 25 bp, Rattus norvegicus
tttaccctacctttgacactgactg

SEQ ID NO: 687717 - DNA, 25 bp, Rattus norvegicus
tttaccctatttcgacagctgagtc

SEQ ID NO: 687718 - DNA, 25 bp, Rattus norvegicus
tttaccctatttggacagctgagtc

SEQ ID NO: 687719 - DNA, 25 bp, Rattus norvegicus
tttaccctcacacctcctgtggaaa

SEQ ID NO: 687720 - DNA, 25 bp, Rattus norvegicus
tttaccctcacagctcctgtggaaa

SEQ ID NO: 687721 - DNA, 25 bp, Rattus norvegicus
tttaccctcataccacagcagatac

SEQ ID NO: 687722 - DNA, 25 bp, Rattus norvegicus
tttaccctcatagcacagcagatac

SEQ ID NO: 687723 - DNA, 25 bp, Rattus norvegicus
tttaccctcgtgaggagcctaagag

SEQ ID NO: 687724 - DNA, 25 bp, Rattus norvegicus
tttaccctcgtgtggagcctaagag

SEQ ID NO: 687725 - DNA, 25 bp, Rattus norvegicus
tttaccctctcacaaatgcctcaaa

SEQ ID NO: 687726 - DNA, 25 bp, Rattus norvegicus
tttaccctctcagaaatgcctcaaa

SEQ ID NO: 687727 - DNA, 25 bp, Rattus norvegicus
tttacccttaatatcacactgcctt

SEQ ID NO: 687728 - DNA, 25 bp, Rattus norvegicus
tttacccttaatttcacactgcctt

SEQ ID NO: 687729 - DNA, 25 bp, Rattus norvegicus
tttacccttactcgtctcagtcagc

SEQ ID NO: 687730 - DNA, 25 bp, Rattus norvegicus
tttacccttactggtctcagtcagc

SEQ ID NO: 687731 - DNA, 25 bp, Rattus norvegicus
tttacccttcctatcttaagcgcat

SEQ ID NO: 687732 - DNA, 25 bp, Rattus norvegicus
tttacccttcctttcttaagcgcat

SEQ ID NO: 687733 - DNA, 25 bp, Rattus norvegicus
tttacccttttaccaagatgacttg

SEQ ID NO: 687734 - DNA, 25 bp, Rattus norvegicus
tttacccttttagcaagatgacttg

SEQ ID NO: 687735 - DNA, 25 bp, Rattus norvegicus
tttacccttttgactgggcaaggag

SEQ ID NO: 687736 - DNA, 25 bp, Rattus norvegicus
tttacccttttgtctgggcaaggag

SEQ ID NO: 687737 - DNA, 25 bp, Rattus norvegicus
tttaccgacagcacagagggacatt

SEQ ID NO: 687738 - DNA, 25 bp, Rattus norvegicus
tttaccgacagctcagagggacatt

SEQ ID NO: 687739 - DNA, 25 bp, Rattus norvegicus
tttaccgactctatgtgaagaagga

SEQ ID NO: 687740 - DNA, 25 bp, Rattus norvegicus
tttaccgactctttgtgaagaagga

SEQ ID NO: 687741 - DNA, 25 bp, Rattus norvegicus
tttaccgagaatctgctcttccact

SEQ ID NO: 687742 - DNA, 25 bp, Rattus norvegicus
tttaccgagaatgtgctcttccact

SEQ ID NO: 687743 - DNA, 25 bp, Rattus norvegicus
tttaccgagactatggaaatcatca

SEQ ID NO: 687744 - DNA, 25 bp, Rattus norvegicus
tttaccgagactttggaaatcatca

SEQ ID NO: 687745 - DNA, 25 bp, Rattus norvegicus
tttaccgatggaacatctctgccac

SEQ ID NO: 687746 - DNA, 25 bp, Rattus norvegicus
tttaccgatggatcatctctgccac

SEQ ID NO: 687747 - DNA, 25 bp, Rattus norvegicus
tttaccgccagaagaaatcgaacag

SEQ ID NO: 687748 - DNA, 25 bp, Rattus norvegicus
tttaccgccagatgaaatcgaacag

SEQ ID NO: 687749 - DNA, 25 bp, Rattus norvegicus
tttaccggcataattcagtcatgtg

SEQ ID NO: 687750 - DNA, 25 bp, Rattus norvegicus
tttaccggcatatttcagtcatgtg

SEQ ID NO: 687751 - DNA, 25 bp, Rattus norvegicus
tttacctacagactcatcttccaaa

SEQ ID NO: 687752 - DNA, 25 bp, Rattus norvegicus
tttacctacagagtcatcttccaaa

SEQ ID NO: 687753 - DNA, 25 bp, Rattus norvegicus
tttacctacctcaaaactgaagctg

SEQ ID NO: 687754 - DNA, 25 bp, Rattus norvegicus
tttacctacctctaaactgaagctg

SEQ ID NO: 687755 - DNA, 25 bp, Rattus norvegicus
tttacctagcagaagcttgaccctg

SEQ ID NO: 687756 - DNA, 25 bp, Rattus norvegicus
tttacctagcagtagcttgaccctg

SEQ ID NO: 687757 - DNA, 25 bp, Rattus norvegicus
tttacctcaaccaacgcaaatcaag

SEQ ID NO: 687758 - DNA, 25 bp, Rattus norvegicus
tttacctcaacctacgcaaatcaag

SEQ ID NO: 687759 - DNA, 25 bp, Rattus norvegicus
tttacctcaactaaatttcgtgtgt

SEQ ID NO: 687760 - DNA, 25 bp, Rattus norvegicus
tttacctcaacttaatttcgtgtgt

SEQ ID NO: 687761 - DNA, 25 bp, Rattus norvegicus
tttacctcaattatgctctaccagc

SEQ ID NO: 687762 - DNA, 25 bp, Rattus norvegicus
tttacctcaattttgctctaccagc

SEQ ID NO: 687763 - DNA, 25 bp, Rattus norvegicus
tttacctcacaaccatacctagaac

SEQ ID NO: 687764 - DNA, 25 bp, Rattus norvegicus
tttacctcacaagcatacctagaac

SEQ ID NO: 687765 - DNA, 25 bp, Rattus norvegicus
tttacctcagatattcaaccagcag

SEQ ID NO: 687766 - DNA, 25 bp, Rattus norvegicus
tttacctcagattttcaaccagcag

SEQ ID NO: 687767 - DNA, 25 bp, Rattus norvegicus
tttacctcagccagtcagtgtgttt

SEQ ID NO: 687768 - DNA, 25 bp, Rattus norvegicus
tttacctcagcctgtcagtgtgttt

SEQ ID NO: 687769 - DNA, 25 bp, Rattus norvegicus
tttacctcaggcatagagctcacct

SEQ ID NO: 687770 - DNA, 25 bp, Rattus norvegicus
tttacctcaggcttagagctcacct

SEQ ID NO: 687771 - DNA, 25 bp, Rattus norvegicus
tttacctcccgaagctgaggcctgg

SEQ ID NO: 687772 - DNA, 25 bp, Rattus norvegicus
tttacctcccgatgctgaggcctgg

SEQ ID NO: 687773 - DNA, 25 bp, Rattus norvegicus
tttacctcgaaacagacatcctatg

SEQ ID NO: 687774 - DNA, 25 bp, Rattus norvegicus
tttacctcgaaagagacatcctatg

SEQ ID NO: 687775 - DNA, 25 bp, Rattus norvegicus
tttacctcgcctcacaggagccttg

SEQ ID NO: 687776 - DNA, 25 bp, Rattus norvegicus
tttacctcgcctgacaggagccttg

SEQ ID NO: 687777 - DNA, 25 bp, Rattus norvegicus
tttacctctcttaacagcgggatct

SEQ ID NO: 687778 - DNA, 25 bp, Rattus norvegicus
tttacctctctttacagcgggatct

SEQ ID NO: 687779 - DNA, 25 bp, Rattus norvegicus
tttacctcttcaatttggtgagatc

SEQ ID NO: 687780 - DNA, 25 bp, Rattus norvegicus
tttacctcttcattttggtgagatc

SEQ ID NO: 687781 - DNA, 25 bp, Rattus norvegicus
tttacctgccaactcctactatgga

SEQ ID NO: 687782 - DNA, 25 bp, Rattus norvegicus
tttacctgccaagtcctactatgga

SEQ ID NO: 687783 - DNA, 25 bp, Rattus norvegicus
tttacctgcttgagcttacttgcca

SEQ ID NO: 687784 - DNA, 25 bp, Rattus norvegicus
tttacctgcttgtgcttacttgcca

SEQ ID NO: 687785 - DNA, 25 bp, Rattus norvegicus
tttacctggagcagcacgacagtcg

SEQ ID NO: 687786 - DNA, 25 bp, Rattus norvegicus
tttacctggagctgcacgacagtcg

SEQ ID NO: 687787 - DNA, 25 bp, Rattus norvegicus
tttacctggcacaacggcaaacagt

SEQ ID NO: 687788 - DNA, 25 bp, Rattus norvegicus
tttacctggcactacggcaaacagt

SEQ ID NO: 687789 - DNA, 25 bp, Rattus norvegicus
tttacctggcatattaggtcctcac

SEQ ID NO: 687790 - DNA, 25 bp, Rattus norvegicus
tttacctggcattttaggtcctcac

SEQ ID NO: 687791 - DNA, 25 bp, Rattus norvegicus
tttacctggcgtatgagaactcaca

SEQ ID NO: 687792 - DNA, 25 bp, Rattus norvegicus
tttacctggcgtttgagaactcaca

SEQ ID NO: 687793 - DNA, 25 bp, Rattus norvegicus
tttacctgggaaaccatactctagt

SEQ ID NO: 687794 - DNA, 25 bp, Rattus norvegicus
tttacctgggaatccatactctagt

SEQ ID NO: 687795 - DNA, 25 bp, Rattus norvegicus
tttacctgggcaacctgattctggg

SEQ ID NO: 687796 - DNA, 25 bp, Rattus norvegicus
tttacctgggcatcctgattctggg

SEQ ID NO: 687797 - DNA, 25 bp, Rattus norvegicus
tttacctgtctaactgaacttcacg

SEQ ID NO: 687798 - DNA, 25 bp, Rattus norvegicus
tttacctgtctatctgaacttcacg

SEQ ID NO: 687799 - DNA, 25 bp, Rattus norvegicus
tttacctgtgcaccctaaagccagt

SEQ ID NO: 687800 - DNA, 25 bp, Rattus norvegicus
tttacctgtgcagcctaaagccagt

SEQ ID NO: 687801 - DNA, 25 bp, Rattus norvegicus
tttacctgttgtcctgttgcatcta

SEQ ID NO: 687802 - DNA, 25 bp, Rattus norvegicus
tttacctgttgtgctgttgcatcta

SEQ ID NO: 687803 - DNA, 25 bp, Rattus norvegicus
tttaccttacctaattgatgctgcc

SEQ ID NO: 687804 - DNA, 25 bp, Rattus norvegicus
tttaccttaccttattgatgctgcc

SEQ ID NO: 687805 - DNA, 25 bp, Rattus norvegicus
tttaccttcatcaccacaatgtgtt

SEQ ID NO: 687806 - DNA, 25 bp, Rattus norvegicus
tttaccttcatctccacaatgtgtt

SEQ ID NO: 687807 - DNA, 25 bp, Rattus norvegicus
tttaccttctcaccatagctactaa

SEQ ID NO: 687808 - DNA, 25 bp, Rattus norvegicus
tttaccttctcagcatagctactaa

SEQ ID NO: 687809 - DNA, 25 bp, Rattus norvegicus
tttaccttctccagtcctgtggaca

SEQ ID NO: 687810 - DNA, 25 bp, Rattus norvegicus
tttaccttctcctgtcctgtggaca

SEQ ID NO: 687811 - DNA, 25 bp, Rattus norvegicus
tttaccttggtgctttgggtgctgc

SEQ ID NO: 687812 - DNA, 25 bp, Rattus norvegicus
tttaccttggtggtttgggtgctgc

SEQ ID NO: 687813 - DNA, 25 bp, Rattus norvegicus
tttaccttgtggacgctagtgctgt

SEQ ID NO: 687814 - DNA, 25 bp, Rattus norvegicus
tttaccttgtggtcgctagtgctgt

SEQ ID NO: 687815 - DNA, 25 bp, Rattus norvegicus
tttacctttatcatcatcatctacc

SEQ ID NO: 687816 - DNA, 25 bp, Rattus norvegicus
tttacctttatcttcatcatctacc

SEQ ID NO: 687817 - DNA, 25 bp, Rattus norvegicus
tttacctttatgactgggcagctca

SEQ ID NO: 687818 - DNA, 25 bp, Rattus norvegicus
tttacctttatgtctgggcagctca

SEQ ID NO: 687819 - DNA, 25 bp, Rattus norvegicus
tttacctttctcatccaatcttgga

SEQ ID NO: 687820 - DNA, 25 bp, Rattus norvegicus
tttacctttctcttccaatcttgga

SEQ ID NO: 687821 - DNA, 25 bp, Rattus norvegicus
tttacgaccagcacagcagcgagta

SEQ ID NO: 687822 - DNA, 25 bp, Rattus norvegicus
tttacgaccagctcagcagcgagta

SEQ ID NO: 687823 - DNA, 25 bp, Rattus norvegicus
tttacgagagtaaagtcgatggcga

SEQ ID NO: 687824 - DNA, 25 bp, Rattus norvegicus
tttacgagagtatagtcgatggcga

SEQ ID NO: 687825 - DNA, 25 bp, Rattus norvegicus
tttacgatcgctctgtcccagtgat

SEQ ID NO: 687826 - DNA, 25 bp, Rattus norvegicus
tttacgatcgctgtgtcccagtgat

SEQ ID NO: 687827 - DNA, 25 bp, Rattus norvegicus
tttacgcactcacctgtgtcacagt

SEQ ID NO: 687828 - DNA, 25 bp, Rattus norvegicus
tttacgcactcagctgtgtcacagt

SEQ ID NO: 687829 - DNA, 25 bp, Rattus norvegicus
tttacgctatctcattaactcccct

SEQ ID NO: 687830 - DNA, 25 bp, Rattus norvegicus
tttacgctatctgattaactcccct

SEQ ID NO: 687831 - DNA, 25 bp, Rattus norvegicus
tttacgctgaccaagttcctttgag

SEQ ID NO: 687832 - DNA, 25 bp, Rattus norvegicus
tttacgctgacctagttcctttgag

SEQ ID NO: 687833 - DNA, 25 bp, Rattus norvegicus
tttacgctttcccttgtcctagttg

SEQ ID NO: 687834 - DNA, 25 bp, Rattus norvegicus
tttacgctttccgttgtcctagttg

SEQ ID NO: 687835 - DNA, 25 bp, Rattus norvegicus
tttacggacatgatgtgccccttcc

SEQ ID NO: 687836 - DNA, 25 bp, Rattus norvegicus
tttacggacatgttgtgccccttcc

SEQ ID NO: 687837 - DNA, 25 bp, Rattus norvegicus
tttacggacctccaggtctttgaga

SEQ ID NO: 687838 - DNA, 25 bp, Rattus norvegicus
tttacggacctcgaggtctttgaga

SEQ ID NO: 687839 - DNA, 25 bp, Rattus norvegicus
tttacggcggcaagggaatctcttc

SEQ ID NO: 687840 - DNA, 25 bp, Rattus norvegicus
tttacggcggcatgggaatctcttc

SEQ ID NO: 687841 - DNA, 25 bp, Rattus norvegicus
tttacggctgttctgtcgtcgatgc

SEQ ID NO: 687842 - DNA, 25 bp, Rattus norvegicus
tttacggctgttgtgtcgtcgatgc

SEQ ID NO: 687843 - DNA, 25 bp, Rattus norvegicus
tttacggtcctcacacagtagttaa

SEQ ID NO: 687844 - DNA, 25 bp, Rattus norvegicus
tttacggtcctctcacagtagttaa

SEQ ID NO: 687845 - DNA, 25 bp, Rattus norvegicus
tttacggtggaaacactgccttgcc

SEQ ID NO: 687846 - DNA, 25 bp, Rattus norvegicus
tttacggtggaatcactgccttgcc

SEQ ID NO: 687847 - DNA, 25 bp, Rattus norvegicus
tttacgtagcgaacggacgcccgcg

SEQ ID NO: 687848 - DNA, 25 bp, Rattus norvegicus
tttacgtagcgatcggacgcccgcg

SEQ ID NO: 687849 - DNA, 25 bp, Rattus norvegicus
tttacgtctcaaacactcgtctaga

SEQ ID NO: 687850 - DNA, 25 bp, Rattus norvegicus
tttacgtctcaatcactcgtctaga

SEQ ID NO: 687851 - DNA, 25 bp, Rattus norvegicus
tttacgtgcctaacagtagctctgg

SEQ ID NO: 687852 - DNA, 25 bp, Rattus norvegicus
tttacgtgcctatcagtagctctgg

SEQ ID NO: 687853 - DNA, 25 bp, Rattus norvegicus
tttacgtggcgcactgtgacatgct

SEQ ID NO: 687854 - DNA, 25 bp, Rattus norvegicus
tttacgtggcgctctgtgacatgct

SEQ ID NO: 687855 - DNA, 25 bp, Rattus norvegicus
tttacgtgtgtgaacgtgcgtgtcc

SEQ ID NO: 687856 - DNA, 25 bp, Rattus norvegicus
tttacgtgtgtgtacgtgcgtgtcc

SEQ ID NO: 687857 - DNA, 25 bp, Rattus norvegicus
tttactaagcagacggtttcggcag

SEQ ID NO: 687858 - DNA, 25 bp, Rattus norvegicus
tttactaagcagtcggtttcggcag

SEQ ID NO: 687859 - DNA, 25 bp, Rattus norvegicus
tttactaaggctcatcccaggacct

SEQ ID NO: 687860 - DNA, 25 bp, Rattus norvegicus
tttactaaggctgatcccaggacct

SEQ ID NO: 687861 - DNA, 25 bp, Rattus norvegicus
tttactacaagcagactcatgacca

SEQ ID NO: 687862 - DNA, 25 bp, Rattus norvegicus
tttactacaagctgactcatgacca

SEQ ID NO: 687863 - DNA, 25 bp, Rattus norvegicus
tttactacactgatcccttcaacgg

SEQ ID NO: 687864 - DNA, 25 bp, Rattus norvegicus
tttactacactgttcccttcaacgg

SEQ ID NO: 687865 - DNA, 25 bp, Rattus norvegicus
tttactacaggccactgagagttct

SEQ ID NO: 687866 - DNA, 25 bp, Rattus norvegicus
tttactacaggcgactgagagttct

SEQ ID NO: 687867 - DNA, 25 bp, Rattus norvegicus
tttactaccagtcgctcaggaaatg

SEQ ID NO: 687868 - DNA, 25 bp, Rattus norvegicus
tttactaccagtggctcaggaaatg

SEQ ID NO: 687869 - DNA, 25 bp, Rattus norvegicus
tttactacgcttcccagatgacgga

SEQ ID NO: 687870 - DNA, 25 bp, Rattus norvegicus
tttactacgcttgccagatgacgga

SEQ ID NO: 687871 - DNA, 25 bp, Rattus norvegicus
tttactactgagctatcttgccagc

SEQ ID NO: 687872 - DNA, 25 bp, Rattus norvegicus
tttactactgaggtatcttgccagc

SEQ ID NO: 687873 - DNA, 25 bp, Rattus norvegicus
tttactactgttattgttgctctca

SEQ ID NO: 687874 - DNA, 25 bp, Rattus norvegicus
tttactactgtttttgttgctctca

SEQ ID NO: 687875 - DNA, 25 bp, Rattus norvegicus
tttactacttgtaacctttcccatg

SEQ ID NO: 687876 - DNA, 25 bp, Rattus norvegicus
tttactacttgttacctttcccatg

SEQ ID NO: 687877 - DNA, 25 bp, Rattus norvegicus
tttactagaggtaccccatgggctt

SEQ ID NO: 687878 - DNA, 25 bp, Rattus norvegicus
tttactagaggttccccatgggctt

SEQ ID NO: 687879 - DNA, 25 bp, Rattus norvegicus
tttactagatccaccacccagctag

SEQ ID NO: 687880 - DNA, 25 bp, Rattus norvegicus
tttactagatcctccacccagctag

SEQ ID NO: 687881 - DNA, 25 bp, Rattus norvegicus
tttactagcttgatctatctctccg

SEQ ID NO: 687882 - DNA, 25 bp, Rattus norvegicus
tttactagcttgttctatctctccg

SEQ ID NO: 687883 - DNA, 25 bp, Rattus norvegicus
tttactaggtgcacctaccttagag

SEQ ID NO: 687884 - DNA, 25 bp, Rattus norvegicus
tttactaggtgctcctaccttagag

SEQ ID NO: 687885 - DNA, 25 bp, Rattus norvegicus
tttactagtctcatttccgtacaca

SEQ ID NO: 687886 - DNA, 25 bp, Rattus norvegicus
tttactagtctcttttccgtacaca

SEQ ID NO: 687887 - DNA, 25 bp, Rattus norvegicus
tttactataggaagagctcgggctc

SEQ ID NO: 687888 - DNA, 25 bp, Rattus norvegicus
tttactataggatgagctcgggctc

SEQ ID NO: 687889 - DNA, 25 bp, Rattus norvegicus
tttactatcatgctcctgacttgga

SEQ ID NO: 687890 - DNA, 25 bp, Rattus norvegicus
tttactatcatggtcctgacttgga

SEQ ID NO: 687891 - DNA, 25 bp, Rattus norvegicus
tttactatcattcttttcttataac

SEQ ID NO: 687892 - DNA, 25 bp, Rattus norvegicus
tttactatcattgttttcttataac

SEQ ID NO: 687893 - DNA, 25 bp, Rattus norvegicus
tttactatctcactatcacccaggc

SEQ ID NO: 687894 - DNA, 25 bp, Rattus norvegicus
tttactatctcagtatcacccaggc

SEQ ID NO: 687895 - DNA, 25 bp, Rattus norvegicus
tttactatgtagatcatcccctaga

SEQ ID NO: 687896 - DNA, 25 bp, Rattus norvegicus
tttactatgtagttcatcccctaga

SEQ ID NO: 687897 - DNA, 25 bp, Rattus norvegicus
tttactcaaagcaaatctacctata

SEQ ID NO: 687898 - DNA, 25 bp, Rattus norvegicus
tttactcaaagctaatctacctata

SEQ ID NO: 687899 - DNA, 25 bp, Rattus norvegicus
tttactcaacaactgcagtccgggt

SEQ ID NO: 687900 - DNA, 25 bp, Rattus norvegicus
tttactcaacaagtgcagtccgggt

SEQ ID NO: 687901 - DNA, 25 bp, Rattus norvegicus
tttactcaagcccccttggagaagt

SEQ ID NO: 687902 - DNA, 25 bp, Rattus norvegicus
tttactcaagccgccttggagaagt

SEQ ID NO: 687903 - DNA, 25 bp, Rattus norvegicus
tttactcagaatcacgctccaatgc

SEQ ID NO: 687904 - DNA, 25 bp, Rattus norvegicus
tttactcagaatgacgctccaatgc

SEQ ID NO: 687905 - DNA, 25 bp, Rattus norvegicus
tttactcagagccattaagcagcag

SEQ ID NO: 687906 - DNA, 25 bp, Rattus norvegicus
tttactcagagcgattaagcagcag

SEQ ID NO: 687907 - DNA, 25 bp, Rattus norvegicus
tttactcaggccagtggaactggaa

SEQ ID NO: 687908 - DNA, 25 bp, Rattus norvegicus
tttactcaggcctgtggaactggaa

SEQ ID NO: 687909 - DNA, 25 bp, Rattus norvegicus
tttactcaggctatctattggcggg

SEQ ID NO: 687910 - DNA, 25 bp, Rattus norvegicus
tttactcaggctttctattggcggg

SEQ ID NO: 687911 - DNA, 25 bp, Rattus norvegicus
tttactcagtctatgatcgtggaaa

SEQ ID NO: 687912 - DNA, 25 bp, Rattus norvegicus
tttactcagtctttgatcgtggaaa

SEQ ID NO: 687913 - DNA, 25 bp, Rattus norvegicus
tttactcatataaccacctatttaa

SEQ ID NO: 687914 - DNA, 25 bp, Rattus norvegicus
tttactcatatatccacctatttaa

SEQ ID NO: 687915 - DNA, 25 bp, Rattus norvegicus
tttactcatcctctttcacttgtac

SEQ ID NO: 687916 - DNA, 25 bp, Rattus norvegicus
tttactcatcctgtttcacttgtac

SEQ ID NO: 687917 - DNA, 25 bp, Rattus norvegicus
tttactcattgtcgtgcacgtttca

SEQ ID NO: 687918 - DNA, 25 bp, Rattus norvegicus
tttactcattgtggtgcacgtttca

SEQ ID NO: 687919 - DNA, 25 bp, Rattus norvegicus
tttactccagttactaaggctacag

SEQ ID NO: 687920 - DNA, 25 bp, Rattus norvegicus
tttactccagtttctaaggctacag

SEQ ID NO: 687921 - DNA, 25 bp, Rattus norvegicus
tttactccatggaggccggagtggc

SEQ ID NO: 687922 - DNA, 25 bp, Rattus norvegicus
tttactccatggtggccggagtggc

SEQ ID NO: 687923 - DNA, 25 bp, Rattus norvegicus
tttactcccatccaagagcacattt

SEQ ID NO: 687924 - DNA, 25 bp, Rattus norvegicus
tttactcccatcgaagagcacattt

SEQ ID NO: 687925 - DNA, 25 bp, Rattus norvegicus
tttactccccaaccaggaaaagcag

SEQ ID NO: 687926 - DNA, 25 bp, Rattus norvegicus
tttactccccaagcaggaaaagcag

SEQ ID NO: 687927 - DNA, 25 bp, Rattus norvegicus
tttactccttgtatcctcactttct

SEQ ID NO: 687928 - DNA, 25 bp, Rattus norvegicus
tttactccttgtttcctcactttct

SEQ ID NO: 687929 - DNA, 25 bp, Rattus norvegicus
tttactcgtacaaagctgtggctgt

SEQ ID NO: 687930 - DNA, 25 bp, Rattus norvegicus
tttactcgtacatagctgtggctgt

SEQ ID NO: 687931 - DNA, 25 bp, Rattus norvegicus
tttactctacttcttttctcgatgt

SEQ ID NO: 687932 - DNA, 25 bp, Rattus norvegicus
tttactctacttgttttctcgatgt

SEQ ID NO: 687933 - DNA, 25 bp, Rattus norvegicus
tttactctcagacaaacacctcgat

SEQ ID NO: 687934 - DNA, 25 bp, Rattus norvegicus
tttactctcagagaaacacctcgat

SEQ ID NO: 687935 - DNA, 25 bp, Rattus norvegicus
tttactctctgccagggtgggaaag

SEQ ID NO: 687936 - DNA, 25 bp, Rattus norvegicus
tttactctctgcgagggtgggaaag

SEQ ID NO: 687937 - DNA, 25 bp, Rattus norvegicus
tttactctctggagctaggacttcc

SEQ ID NO: 687938 - DNA, 25 bp, Rattus norvegicus
tttactctctggtgctaggacttcc

SEQ ID NO: 687939 - DNA, 25 bp, Rattus norvegicus
tttactctgtagatgctcacttctg

SEQ ID NO: 687940 - DNA, 25 bp, Rattus norvegicus
tttactctgtagttgctcacttctg

SEQ ID NO: 687941 - DNA, 25 bp, Rattus norvegicus
tttactcttctcagctaatgacatg

SEQ ID NO: 687942 - DNA, 25 bp, Rattus norvegicus
tttactcttctctgctaatgacatg

SEQ ID NO: 687943 - DNA, 25 bp, Rattus norvegicus
tttactcttctgatacatcatctag

SEQ ID NO: 687944 - DNA, 25 bp, Rattus norvegicus
tttactcttctgttacatcatctag

SEQ ID NO: 687945 - DNA, 25 bp, Rattus norvegicus
tttactcttcttaccttctgacatt

SEQ ID NO: 687946 - DNA, 25 bp, Rattus norvegicus
tttactcttctttccttctgacatt

SEQ ID NO: 687947 - DNA, 25 bp, Rattus norvegicus
tttactgacatgctgctgtgtggta

SEQ ID NO: 687948 - DNA, 25 bp, Rattus norvegicus
tttactgacatggtgctgtgtggta

SEQ ID NO: 687949 - DNA, 25 bp, Rattus norvegicus
tttactgaccacatcacattactcc

SEQ ID NO: 687950 - DNA, 25 bp, Rattus norvegicus
tttactgaccacttcacattactcc

SEQ ID NO: 687951 - DNA, 25 bp, Rattus norvegicus
tttactgactgactgacctctttgc

SEQ ID NO: 687952 - DNA, 25 bp, Rattus norvegicus
tttactgactgagtgacctctttgc

SEQ ID NO: 687953 - DNA, 25 bp, Rattus norvegicus
tttactgagacaacaccaacctctg

SEQ ID NO: 687954 - DNA, 25 bp, Rattus norvegicus
tttactgagacatcaccaacctctg

SEQ ID NO: 687955 - DNA, 25 bp, Rattus norvegicus
tttactgagaggaacggtccatgaa

SEQ ID NO: 687956 - DNA, 25 bp, Rattus norvegicus
tttactgagaggtacggtccatgaa

SEQ ID NO: 687957 - DNA, 25 bp, Rattus norvegicus
tttactgagggaccgaccgagtctt

SEQ ID NO: 687958 - DNA, 25 bp, Rattus norvegicus
tttactgagggagcgaccgagtctt

SEQ ID NO: 687959 - DNA, 25 bp, Rattus norvegicus
tttactgcagcaatcggaggtgaca

SEQ ID NO: 687960 - DNA, 25 bp, Rattus norvegicus
tttactgcagcattcggaggtgaca

SEQ ID NO: 687961 - DNA, 25 bp, Rattus norvegicus
tttactgcagtgacgccgtgggacg

SEQ ID NO: 687962 - DNA, 25 bp, Rattus norvegicus
tttactgcagtgtcgccgtgggacg

SEQ ID NO: 687963 - DNA, 25 bp, Rattus norvegicus
tttactgcagttatcaggagcgcaa

SEQ ID NO: 687964 - DNA, 25 bp, Rattus norvegicus
tttactgcagttttcaggagcgcaa

SEQ ID NO: 687965 - DNA, 25 bp, Rattus norvegicus
tttactgcatgcacaggtcgctgca

SEQ ID NO: 687966 - DNA, 25 bp, Rattus norvegicus
tttactgcatgctcaggtcgctgca

SEQ ID NO: 687967 - DNA, 25 bp, Rattus norvegicus
tttactgcatggcattcattatagt

SEQ ID NO: 687968 - DNA, 25 bp, Rattus norvegicus
tttactgcatgggattcattatagt

SEQ ID NO: 687969 - DNA, 25 bp, Rattus norvegicus
tttactgcatttcttctcgctgtac

SEQ ID NO: 687970 - DNA, 25 bp, Rattus norvegicus
tttactgcatttgttctcgctgtac

SEQ ID NO: 687971 - DNA, 25 bp, Rattus norvegicus
tttactgccctacctttgttagtgc

SEQ ID NO: 687972 - DNA, 25 bp, Rattus norvegicus
tttactgccctagctttgttagtgc

SEQ ID NO: 687973 - DNA, 25 bp, Rattus norvegicus
tttactgccgacagagcttcttcag

SEQ ID NO: 687974 - DNA, 25 bp, Rattus norvegicus
tttactgccgactgagcttcttcag

SEQ ID NO: 687975 - DNA, 25 bp, Rattus norvegicus
tttactgccttgaattgtggttatg

SEQ ID NO: 687976 - DNA, 25 bp, Rattus norvegicus
tttactgccttgactgttacgtgta

SEQ ID NO: 687977 - DNA, 25 bp, Rattus norvegicus
tttactgccttgtattgtggttatg

SEQ ID NO: 687978 - DNA, 25 bp, Rattus norvegicus
tttactgccttgtctgttacgtgta

SEQ ID NO: 687979 - DNA, 25 bp, Rattus norvegicus
tttactgctctcactacccatgtgt

SEQ ID NO: 687980 - DNA, 25 bp, Rattus norvegicus
tttactgctctctctacccatgtgt

SEQ ID NO: 687981 - DNA, 25 bp, Rattus norvegicus
tttactgctgcaaattgttccggcc

SEQ ID NO: 687982 - DNA, 25 bp, Rattus norvegicus
tttactgctgcatattgttccggcc

SEQ ID NO: 687983 - DNA, 25 bp, Rattus norvegicus
tttactgctgccaatcaaaccttct

SEQ ID NO: 687984 - DNA, 25 bp, Rattus norvegicus
tttactgctgcctatcaaaccttct

SEQ ID NO: 687985 - DNA, 25 bp, Rattus norvegicus
tttactgcttcactaatgcctctgg

SEQ ID NO: 687986 - DNA, 25 bp, Rattus norvegicus
tttactgcttcagtaatgcctctgg

SEQ ID NO: 687987 - DNA, 25 bp, Rattus norvegicus
tttactggaagcaacgctggctcgc

SEQ ID NO: 687988 - DNA, 25 bp, Rattus norvegicus
tttactggaagctacgctggctcgc

SEQ ID NO: 687989 - DNA, 25 bp, Rattus norvegicus
tttactggcagaactcgacgaggtc

SEQ ID NO: 687990 - DNA, 25 bp, Rattus norvegicus
tttactggcagatctcgacgaggtc

SEQ ID NO: 687991 - DNA, 25 bp, Rattus norvegicus
tttactggcctcaaatagctgcttt

SEQ ID NO: 687992 - DNA, 25 bp, Rattus norvegicus
tttactggcctctaatagctgcttt

SEQ ID NO: 687993 - DNA, 25 bp, Rattus norvegicus
tttactgggctcctctgagtttgaa

SEQ ID NO: 687994 - DNA, 25 bp, Rattus norvegicus
tttactgggctcgtctgagtttgaa

SEQ ID NO: 687995 - DNA, 25 bp, Rattus norvegicus
tttactggtttcattgtgaagctga

SEQ ID NO: 687996 - DNA, 25 bp, Rattus norvegicus
tttactggtttctttgtgaagctga

SEQ ID NO: 687997 - DNA, 25 bp, Rattus norvegicus
tttactgtagacctttttcacccat

SEQ ID NO: 687998 - DNA, 25 bp, Rattus norvegicus
tttactgtagacgtttttcacccat

SEQ ID NO: 687999 - DNA, 25 bp, Rattus norvegicus
tttactgtattgatgtaaagcacct

SEQ ID NO: 688000 - DNA, 25 bp, Rattus norvegicus
tttactgtattgttgtaaagcacct

SEQ ID NO: 688001 - DNA, 25 bp, Rattus norvegicus
tttactgtcaagaagacccatacgg

SEQ ID NO: 688002 - DNA, 25 bp, Rattus norvegicus
tttactgtcaagtagacccatacgg

SEQ ID NO: 688003 - DNA, 25 bp, Rattus norvegicus
tttactgtcccacctgtgatttttt

SEQ ID NO: 688004 - DNA, 25 bp, Rattus norvegicus
tttactgtcccagctgtgatttttt

SEQ ID NO: 688005 - DNA, 25 bp, Rattus norvegicus
tttactgtgctaagctaggtccaag

SEQ ID NO: 688006 - DNA, 25 bp, Rattus norvegicus
tttactgtgctatgctaggtccaag

SEQ ID NO: 688007 - DNA, 25 bp, Rattus norvegicus
tttactgtggtacggcatgcctgac

SEQ ID NO: 688008 - DNA, 25 bp, Rattus norvegicus
tttactgtggtagggcatgcctgac

SEQ ID NO: 688009 - DNA, 25 bp, Rattus norvegicus
tttactgttaaacccacagcctccg

SEQ ID NO: 688010 - DNA, 25 bp, Rattus norvegicus
tttactgttaaagccacagcctccg

SEQ ID NO: 688011 - DNA, 25 bp, Rattus norvegicus
tttactgttaatcactccccgactt

SEQ ID NO: 688012 - DNA, 25 bp, Rattus norvegicus
tttactgttaatgactccccgactt

SEQ ID NO: 688013 - DNA, 25 bp, Rattus norvegicus
tttactgttatcataactgcgtgtt

SEQ ID NO: 688014 - DNA, 25 bp, Rattus norvegicus
tttactgttatcttaactgcgtgtt

SEQ ID NO: 688015 - DNA, 25 bp, Rattus norvegicus
tttactgttcctcggatcaccttat

SEQ ID NO: 688016 - DNA, 25 bp, Rattus norvegicus
tttactgttcctgggatcaccttat

SEQ ID NO: 688017 - DNA, 25 bp, Rattus norvegicus
tttactgttcttcgtcttctttgtt

SEQ ID NO: 688018 - DNA, 25 bp, Rattus norvegicus
tttactgttcttggtcttctttgtt

SEQ ID NO: 688019 - DNA, 25 bp, Rattus norvegicus
tttactgttgtgaaattaccagagt

SEQ ID NO: 688020 - DNA, 25 bp, Rattus norvegicus
tttactgttgtgtaattaccagagt

SEQ ID NO: 688021 - DNA, 25 bp, Rattus norvegicus
tttactgtttacattcttgccacac

SEQ ID NO: 688022 - DNA, 25 bp, Rattus norvegicus
tttactgtttactttcttgccacac

SEQ ID NO: 688023 - DNA, 25 bp, Rattus norvegicus
tttactgtttccatcgactctctag

SEQ ID NO: 688024 - DNA, 25 bp, Rattus norvegicus
tttactgtttcccatacagctcgtc

SEQ ID NO: 688025 - DNA, 25 bp, Rattus norvegicus
tttactgtttccgatacagctcgtc

SEQ ID NO: 688026 - DNA, 25 bp, Rattus norvegicus
tttactgtttccttcgactctctag

SEQ ID NO: 688027 - DNA, 25 bp, Rattus norvegicus
tttactgttttcattgtgccttaag

SEQ ID NO: 688028 - DNA, 25 bp, Rattus norvegicus
tttactgttttctttgtgccttaag

SEQ ID NO: 688029 - DNA, 25 bp, Rattus norvegicus
tttacttaaataacctctctaccct

SEQ ID NO: 688030 - DNA, 25 bp, Rattus norvegicus
tttacttaaatatcctctctaccct

SEQ ID NO: 688031 - DNA, 25 bp, Rattus norvegicus
tttacttacctgatccagctgctag

SEQ ID NO: 688032 - DNA, 25 bp, Rattus norvegicus
tttacttacctgttccagctgctag

SEQ ID NO: 688033 - DNA, 25 bp, Rattus norvegicus
tttacttagattcacaccaacctcc

SEQ ID NO: 688034 - DNA, 25 bp, Rattus norvegicus
tttacttagattgacaccaacctcc

SEQ ID NO: 688035 - DNA, 25 bp, Rattus norvegicus
tttacttcatggattctttcctact

SEQ ID NO: 688036 - DNA, 25 bp, Rattus norvegicus
tttacttcatggtttctttcctact

SEQ ID NO: 688037 - DNA, 25 bp, Rattus norvegicus
tttacttccataattggccaattga

SEQ ID NO: 688038 - DNA, 25 bp, Rattus norvegicus
tttacttccatatttggccaattga

SEQ ID NO: 688039 - DNA, 25 bp, Rattus norvegicus
tttacttccttaccatcaaagctgc

SEQ ID NO: 688040 - DNA, 25 bp, Rattus norvegicus
tttacttccttagcatcaaagctgc

SEQ ID NO: 688041 - DNA, 25 bp, Rattus norvegicus
tttacttcctttagcttctgattga

SEQ ID NO: 688042 - DNA, 25 bp, Rattus norvegicus
tttacttccttttgcttctgattga

SEQ ID NO: 688043 - DNA, 25 bp, Rattus norvegicus
tttacttcgcagaagagcctccagc

SEQ ID NO: 688044 - DNA, 25 bp, Rattus norvegicus
tttacttcgcagtagagcctccagc

SEQ ID NO: 688045 - DNA, 25 bp, Rattus norvegicus
tttacttctacacagacccagagga

SEQ ID NO: 688046 - DNA, 25 bp, Rattus norvegicus
tttacttctacagagacccagagga

SEQ ID NO: 688047 - DNA, 25 bp, Rattus norvegicus
tttacttctgaacctagagctcctg

SEQ ID NO: 688048 - DNA, 25 bp, Rattus norvegicus
tttacttctgaagctagagctcctg

SEQ ID NO: 688049 - DNA, 25 bp, Rattus norvegicus
tttacttggatcacactctctccaa

SEQ ID NO: 688050 - DNA, 25 bp, Rattus norvegicus
tttacttggatctcactctctccaa

SEQ ID NO: 688051 - DNA, 25 bp, Rattus norvegicus
tttacttgtgaccatttacttcctc

SEQ ID NO: 688052 - DNA, 25 bp, Rattus norvegicus
tttacttgtgacgatttacttcctc

SEQ ID NO: 688053 - DNA, 25 bp, Rattus norvegicus
tttactttagcgcttgcctcctagg

SEQ ID NO: 688054 - DNA, 25 bp, Rattus norvegicus
tttactttagcggttgcctcctagg

SEQ ID NO: 688055 - DNA, 25 bp, Rattus norvegicus
tttactttatctatccaactcctgc

SEQ ID NO: 688056 - DNA, 25 bp, Rattus norvegicus
tttactttatctttccaactcctgc

SEQ ID NO: 688057 - DNA, 25 bp, Rattus norvegicus
tttactttcactcagaatccggcat

SEQ ID NO: 688058 - DNA, 25 bp, Rattus norvegicus
tttactttcactgagaatccggcat

SEQ ID NO: 688059 - DNA, 25 bp, Rattus norvegicus
tttactttccttcgcagataaacgc

SEQ ID NO: 688060 - DNA, 25 bp, Rattus norvegicus
tttactttccttggcagataaacgc

SEQ ID NO: 688061 - DNA, 25 bp, Rattus norvegicus
tttactttctggacagggctccaca

SEQ ID NO: 688062 - DNA, 25 bp, Rattus norvegicus
tttactttctggtcagggctccaca

SEQ ID NO: 688063 - DNA, 25 bp, Rattus norvegicus
tttactttgctaagccaatggcctg

SEQ ID NO: 688064 - DNA, 25 bp, Rattus norvegicus
tttactttgctatgccaatggcctg

SEQ ID NO: 688065 - DNA, 25 bp, Rattus norvegicus
tttacttttctgactgttgccaaca

SEQ ID NO: 688066 - DNA, 25 bp, Rattus norvegicus
tttacttttctgtctgttgccaaca

SEQ ID NO: 688067 - DNA, 25 bp, Rattus norvegicus
tttactttttcaagtctgcgtccta

SEQ ID NO: 688068 - DNA, 25 bp, Rattus norvegicus
tttactttttcatgtctgcgtccta

SEQ ID NO: 688069 - DNA, 25 bp, Rattus norvegicus
tttagaaaccatatccagatgctgg

SEQ ID NO: 688070 - DNA, 25 bp, Rattus norvegicus
tttagaaaccatttccagatgctgg

SEQ ID NO: 688071 - DNA, 25 bp, Rattus norvegicus
tttagaaactcacctccccaggatt

SEQ ID NO: 688072 - DNA, 25 bp, Rattus norvegicus
tttagaaactcagctccccaggatt

SEQ ID NO: 688073 - DNA, 25 bp, Rattus norvegicus
tttagaaagatcatcctctcccctg

SEQ ID NO: 688074 - DNA, 25 bp, Rattus norvegicus
tttagaaagatcttcctctcccctg

SEQ ID NO: 688075 - DNA, 25 bp, Rattus norvegicus
tttagaaatcttcatgccccaagcc

SEQ ID NO: 688076 - DNA, 25 bp, Rattus norvegicus
tttagaaatcttgatgccccaagcc

SEQ ID NO: 688077 - DNA, 25 bp, Rattus norvegicus
tttagaaatgaacgcacacctcctc

SEQ ID NO: 688078 - DNA, 25 bp, Rattus norvegicus
tttagaaatgaaggcacacctcctc

SEQ ID NO: 688079 - DNA, 25 bp, Rattus norvegicus
tttagaaattccctggtgctattcc

SEQ ID NO: 688080 - DNA, 25 bp, Rattus norvegicus
tttagaaattccgtggtgctattcc

SEQ ID NO: 688081 - DNA, 25 bp, Rattus norvegicus
tttagaaattctcccctttgtgttg

SEQ ID NO: 688082 - DNA, 25 bp, Rattus norvegicus
tttagaaattctgccctttgtgttg

SEQ ID NO: 688083 - DNA, 25 bp, Rattus norvegicus
tttagaaatttaacagactggctca

SEQ ID NO: 688084 - DNA, 25 bp, Rattus norvegicus
tttagaaatttatcagactggctca

SEQ ID NO: 688085 - DNA, 25 bp, Rattus norvegicus
tttagaacaactcctcactctgacc

SEQ ID NO: 688086 - DNA, 25 bp, Rattus norvegicus
tttagaacaactgctcactctgacc

SEQ ID NO: 688087 - DNA, 25 bp, Rattus norvegicus
tttagaacaccccactacagtttgt

SEQ ID NO: 688088 - DNA, 25 bp, Rattus norvegicus
tttagaacacccgactacagtttgt

SEQ ID NO: 688089 - DNA, 25 bp, Rattus norvegicus
tttagaacatggactgctcttacag

SEQ ID NO: 688090 - DNA, 25 bp, Rattus norvegicus
tttagaacatggtctgctcttacag

SEQ ID NO: 688091 - DNA, 25 bp, Rattus norvegicus
tttagaacggcaccactaacagcac

SEQ ID NO: 688092 - DNA, 25 bp, Rattus norvegicus
tttagaacggcagcactaacagcac

SEQ ID NO: 688093 - DNA, 25 bp, Rattus norvegicus
tttagaacgtgtcacttcctcgagc

SEQ ID NO: 688094 - DNA, 25 bp, Rattus norvegicus
tttagaacgtgtgacttcctcgagc

SEQ ID NO: 688095 - DNA, 25 bp, Rattus norvegicus
tttagaactgctagaagccctcacc

SEQ ID NO: 688096 - DNA, 25 bp, Rattus norvegicus
tttagaactgcttgaagccctcacc

SEQ ID NO: 688097 - DNA, 25 bp, Rattus norvegicus
tttagaactgtacgtccgtggtaag

SEQ ID NO: 688098 - DNA, 25 bp, Rattus norvegicus
tttagaactgtaggtccgtggtaag

SEQ ID NO: 688099 - DNA, 25 bp, Rattus norvegicus
tttagaagagttcggacgctctcaa

SEQ ID NO: 688100 - DNA, 25 bp, Rattus norvegicus
tttagaagagttgggacgctctcaa

SEQ ID NO: 688101 - DNA, 25 bp, Rattus norvegicus
tttagaagccacagccgccataggg

SEQ ID NO: 688102 - DNA, 25 bp, Rattus norvegicus
tttagaagccactgccgccataggg

SEQ ID NO: 688103 - DNA, 25 bp, Rattus norvegicus
tttagaagcctcacaatcctagcac

SEQ ID NO: 688104 - DNA, 25 bp, Rattus norvegicus
tttagaagcctctcaatcctagcac

SEQ ID NO: 688105 - DNA, 25 bp, Rattus norvegicus
tttagaagctgccatcaccgagcga

SEQ ID NO: 688106 - DNA, 25 bp, Rattus norvegicus
tttagaagctgcgatcaccgagcga

SEQ ID NO: 688107 - DNA, 25 bp, Rattus norvegicus
tttagaatcaagactccctgagata

SEQ ID NO: 688108 - DNA, 25 bp, Rattus norvegicus
tttagaatcaagtctccctgagata

SEQ ID NO: 688109 - DNA, 25 bp, Rattus norvegicus
tttagaatccgtcctcgtggtctct

SEQ ID NO: 688110 - DNA, 25 bp, Rattus norvegicus
tttagaatccgtgctcgtggtctct

SEQ ID NO: 688111 - DNA, 25 bp, Rattus norvegicus
tttagaatgcctatattgcctcccc

SEQ ID NO: 688112 - DNA, 25 bp, Rattus norvegicus
tttagaatgcctttattgcctcccc

SEQ ID NO: 688113 - DNA, 25 bp, Rattus norvegicus
tttagaattcctcgtgccactcagc

SEQ ID NO: 688114 - DNA, 25 bp, Rattus norvegicus
tttagaattcctggtgccactcagc

SEQ ID NO: 688115 - DNA, 25 bp, Rattus norvegicus
tttagacaagagaccactccgttag

SEQ ID NO: 688116 - DNA, 25 bp, Rattus norvegicus
tttagacaagagtccactccgttag

SEQ ID NO: 688117 - DNA, 25 bp, Rattus norvegicus
tttagacacgacagccacagtttgg

SEQ ID NO: 688118 - DNA, 25 bp, Rattus norvegicus
tttagacacgactgccacagtttgg

SEQ ID NO: 688119 - DNA, 25 bp, Rattus norvegicus
tttagacatctcctttgatgcccca

SEQ ID NO: 688120 - DNA, 25 bp, Rattus norvegicus
tttagacatctcgtttgatgcccca

SEQ ID NO: 688121 - DNA, 25 bp, Rattus norvegicus
tttagacatggtaagtgccccttgg

SEQ ID NO: 688122 - DNA, 25 bp, Rattus norvegicus
tttagacatggttagtgccccttgg

SEQ ID NO: 688123 - DNA, 25 bp, Rattus norvegicus
tttagaccaaaacaagccactgtgt

SEQ ID NO: 688124 - DNA, 25 bp, Rattus norvegicus
tttagaccaaaagaagccactgtgt

SEQ ID NO: 688125 - DNA, 25 bp, Rattus norvegicus
tttagaccaaatccaggcctagctc

SEQ ID NO: 688126 - DNA, 25 bp, Rattus norvegicus
tttagaccaaatgcaggcctagctc

SEQ ID NO: 688127 - DNA, 25 bp, Rattus norvegicus
tttagaccactgcattttgcgcttc

SEQ ID NO: 688128 - DNA, 25 bp, Rattus norvegicus
tttagaccactggattttgcgcttc

SEQ ID NO: 688129 - DNA, 25 bp, Rattus norvegicus
tttagaccaggtcgaaccccagtca

SEQ ID NO: 688130 - DNA, 25 bp, Rattus norvegicus
tttagaccaggtggaaccccagtca

SEQ ID NO: 688131 - DNA, 25 bp, Rattus norvegicus
tttagaccctttagatgccatctca

SEQ ID NO: 688132 - DNA, 25 bp, Rattus norvegicus
tttagacccttttgatgccatctca

SEQ ID NO: 688133 - DNA, 25 bp, Rattus norvegicus
tttagaccggctattgtagatacaa

SEQ ID NO: 688134 - DNA, 25 bp, Rattus norvegicus
tttagaccggcttttgtagatacaa

SEQ ID NO: 688135 - DNA, 25 bp, Rattus norvegicus
tttagacctccacagggacagacct

SEQ ID NO: 688136 - DNA, 25 bp, Rattus norvegicus
tttagacctccagagggacagacct

SEQ ID NO: 688137 - DNA, 25 bp, Rattus norvegicus
tttagacctctacactggaaataat

SEQ ID NO: 688138 - DNA, 25 bp, Rattus norvegicus
tttagacctctagactggaaataat

SEQ ID NO: 688139 - DNA, 25 bp, Rattus norvegicus
tttagacggcatcggagtaacttgg

SEQ ID NO: 688140 - DNA, 25 bp, Rattus norvegicus
tttagacggcatgggagtaacttgg

SEQ ID NO: 688141 - DNA, 25 bp, Rattus norvegicus
tttagactcagtattgccaatgtaa

SEQ ID NO: 688142 - DNA, 25 bp, Rattus norvegicus
tttagactcagttttgccaatgtaa

SEQ ID NO: 688143 - DNA, 25 bp, Rattus norvegicus
tttagacttaaacactccacttttg

SEQ ID NO: 688144 - DNA, 25 bp, Rattus norvegicus
tttagacttaaagactccacttttg

SEQ ID NO: 688145 - DNA, 25 bp, Rattus norvegicus
tttagacttgatctagaacccttgt

SEQ ID NO: 688146 - DNA, 25 bp, Rattus norvegicus
tttagacttgatgtagaacccttgt

SEQ ID NO: 688147 - DNA, 25 bp, Rattus norvegicus
tttagacttgggaacttggtggctg

SEQ ID NO: 688148 - DNA, 25 bp, Rattus norvegicus
tttagacttgggtacttggtggctg

SEQ ID NO: 688149 - DNA, 25 bp, Rattus norvegicus
tttagacttgttactttcttcatta

SEQ ID NO: 688150 - DNA, 25 bp, Rattus norvegicus
tttagacttgtttctttcttcatta

SEQ ID NO: 688151 - DNA, 25 bp, Rattus norvegicus
tttagactttcacattctctcagcg

SEQ ID NO: 688152 - DNA, 25 bp, Rattus norvegicus
tttagactttcagattctctcagcg

SEQ ID NO: 688153 - DNA, 25 bp, Rattus norvegicus
tttagagaccgcctaggacctcacg

SEQ ID NO: 688154 - DNA, 25 bp, Rattus norvegicus
tttagagaccgcgtaggacctcacg

SEQ ID NO: 688155 - DNA, 25 bp, Rattus norvegicus
tttagagacgttatgcctgcgcaca

SEQ ID NO: 688156 - DNA, 25 bp, Rattus norvegicus
tttagagacgttttgcctgcgcaca

SEQ ID NO: 688157 - DNA, 25 bp, Rattus norvegicus
tttagagcattgagccccaacatgg

SEQ ID NO: 688158 - DNA, 25 bp, Rattus norvegicus
tttagagcattgtgccccaacatgg

SEQ ID NO: 688159 - DNA, 25 bp, Rattus norvegicus
tttagagccacaactgcacaggacc

SEQ ID NO: 688160 - DNA, 25 bp, Rattus norvegicus
tttagagccacatctgcacaggacc

SEQ ID NO: 688161 - DNA, 25 bp, Rattus norvegicus
tttagagccattcctcttcctcaga

SEQ ID NO: 688162 - DNA, 25 bp, Rattus norvegicus
tttagagccattgctcttcctcaga

SEQ ID NO: 688163 - DNA, 25 bp, Rattus norvegicus
tttagagctgccagccccaagtggg

SEQ ID NO: 688164 - DNA, 25 bp, Rattus norvegicus
tttagagctgcctgccccaagtggg

SEQ ID NO: 688165 - DNA, 25 bp, Rattus norvegicus
tttagaggcaggctaccacgtgtcc

SEQ ID NO: 688166 - DNA, 25 bp, Rattus norvegicus
tttagaggcagggtaccacgtgtcc

SEQ ID NO: 688167 - DNA, 25 bp, Rattus norvegicus
tttagaggcttcatcactcctgcag

SEQ ID NO: 688168 - DNA, 25 bp, Rattus norvegicus
tttagaggcttcttcactcctgcag

SEQ ID NO: 688169 - DNA, 25 bp, Rattus norvegicus
tttagagggcccacaaagtccatcc

SEQ ID NO: 688170 - DNA, 25 bp, Rattus norvegicus
tttagagggccctcaaagtccatcc

SEQ ID NO: 688171 - DNA, 25 bp, Rattus norvegicus
tttagaggtgataatctcccagggt

SEQ ID NO: 688172 - DNA, 25 bp, Rattus norvegicus
tttagaggtgatacttggcccaaac

SEQ ID NO: 688173 - DNA, 25 bp, Rattus norvegicus
tttagaggtgattatctcccagggt

SEQ ID NO: 688174 - DNA, 25 bp, Rattus norvegicus
tttagaggtgattcttggcccaaac

SEQ ID NO: 688175 - DNA, 25 bp, Rattus norvegicus
tttagaggttccagagcattcgcag

SEQ ID NO: 688176 - DNA, 25 bp, Rattus norvegicus
tttagaggttcctgagcattcgcag

SEQ ID NO: 688177 - DNA, 25 bp, Rattus norvegicus
tttagagtccaacccgtgccactaa

SEQ ID NO: 688178 - DNA, 25 bp, Rattus norvegicus
tttagagtccaagccgtgccactaa

SEQ ID NO: 688179 - DNA, 25 bp, Rattus norvegicus
tttagagtcctccacagcaacatga

SEQ ID NO: 688180 - DNA, 25 bp, Rattus norvegicus
tttagagtcctcgacagcaacatga

SEQ ID NO: 688181 - DNA, 25 bp, Rattus norvegicus
tttagagttaatactgtgcctccag

SEQ ID NO: 688182 - DNA, 25 bp, Rattus norvegicus
tttagagttaattctgtgcctccag

SEQ ID NO: 688183 - DNA, 25 bp, Rattus norvegicus
tttagagttggccttcctttgttga

SEQ ID NO: 688184 - DNA, 25 bp, Rattus norvegicus
tttagagttggcgttcctttgttga

SEQ ID NO: 688185 - DNA, 25 bp, Rattus norvegicus
tttagatagactccagctccagcct

SEQ ID NO: 688186 - DNA, 25 bp, Rattus norvegicus
tttagatagactgcagctccagcct

SEQ ID NO: 688187 - DNA, 25 bp, Rattus norvegicus
tttagatagtcaagcttctcgccac

SEQ ID NO: 688188 - DNA, 25 bp, Rattus norvegicus
tttagatagtcatgcttctcgccac

SEQ ID NO: 688189 - DNA, 25 bp, Rattus norvegicus
tttagatattgcacactctgacagt

SEQ ID NO: 688190 - DNA, 25 bp, Rattus norvegicus
tttagatattgctcactctgacagt

SEQ ID NO: 688191 - DNA, 25 bp, Rattus norvegicus
tttagatcagtcactagggtcccca

SEQ ID NO: 688192 - DNA, 25 bp, Rattus norvegicus
tttagatcagtctctagggtcccca

SEQ ID NO: 688193 - DNA, 25 bp, Rattus norvegicus
tttagatcctatatttcaccctgcg

SEQ ID NO: 688194 - DNA, 25 bp, Rattus norvegicus
tttagatcctatttttcaccctgcg

SEQ ID NO: 688195 - DNA, 25 bp, Rattus norvegicus
tttagatcctggaatccctgctgtc

SEQ ID NO: 688196 - DNA, 25 bp, Rattus norvegicus
tttagatcctggtatccctgctgtc

SEQ ID NO: 688197 - DNA, 25 bp, Rattus norvegicus
tttagatgctttacttcttccgctg

SEQ ID NO: 688198 - DNA, 25 bp, Rattus norvegicus
tttagatgcttttcttcttccgctg

SEQ ID NO: 688199 - DNA, 25 bp, Rattus norvegicus
tttagatgtctcaggcactgaaata

SEQ ID NO: 688200 - DNA, 25 bp, Rattus norvegicus
tttagatgtctctggcactgaaata

SEQ ID NO: 688201 - DNA, 25 bp, Rattus norvegicus
tttagattccttactggttacagac

SEQ ID NO: 688202 - DNA, 25 bp, Rattus norvegicus
tttagattcctttctggttacagac

SEQ ID NO: 688203 - DNA, 25 bp, Rattus norvegicus
tttagattgaatagccctgttgtat

SEQ ID NO: 688204 - DNA, 25 bp, Rattus norvegicus
tttagattgaattgccctgttgtat

SEQ ID NO: 688205 - DNA, 25 bp, Rattus norvegicus
tttagattgtttacactcttctggg

SEQ ID NO: 688206 - DNA, 25 bp, Rattus norvegicus
tttagattgttttcactcttctggg

SEQ ID NO: 688207 - DNA, 25 bp, Rattus norvegicus
tttagcaaacgtactgtctgtccag

SEQ ID NO: 688208 - DNA, 25 bp, Rattus norvegicus
tttagcaaacgttctgtctgtccag

SEQ ID NO: 688209 - DNA, 25 bp, Rattus norvegicus
tttagcaaatcaacaaagcacagtt

SEQ ID NO: 688210 - DNA, 25 bp, Rattus norvegicus
tttagcaaatcatcaaagcacagtt

SEQ ID NO: 688211 - DNA, 25 bp, Rattus norvegicus
tttagcaaccctacttccaaagaca

SEQ ID NO: 688212 - DNA, 25 bp, Rattus norvegicus
tttagcaacccttcttccaaagaca

SEQ ID NO: 688213 - DNA, 25 bp, Rattus norvegicus
tttagcaacttcaggccaggctcaa

SEQ ID NO: 688214 - DNA, 25 bp, Rattus norvegicus
tttagcaacttctggccaggctcaa

SEQ ID NO: 688215 - DNA, 25 bp, Rattus norvegicus
tttagcaatttcaccatcgggctgc

SEQ ID NO: 688216 - DNA, 25 bp, Rattus norvegicus
tttagcaatttctccatcgggctgc

SEQ ID NO: 688217 - DNA, 25 bp, Rattus norvegicus
tttagcacacggacaagcactatga

SEQ ID NO: 688218 - DNA, 25 bp, Rattus norvegicus
tttagcacacggtcaagcactatga

SEQ ID NO: 688219 - DNA, 25 bp, Rattus norvegicus
tttagcacatggctggctctagcac

SEQ ID NO: 688220 - DNA, 25 bp, Rattus norvegicus
tttagcacatgggtggctctagcac

SEQ ID NO: 688221 - DNA, 25 bp, Rattus norvegicus
tttagcaccatcaagcccatgtatg

SEQ ID NO: 688222 - DNA, 25 bp, Rattus norvegicus
tttagcaccatctagcccatgtatg

SEQ ID NO: 688223 - DNA, 25 bp, Rattus norvegicus
tttagcactactcgaaggttctctc

SEQ ID NO: 688224 - DNA, 25 bp, Rattus norvegicus
tttagcactactggaaggttctctc

SEQ ID NO: 688225 - DNA, 25 bp, Rattus norvegicus
tttagcactgacatctgacctgcga

SEQ ID NO: 688226 - DNA, 25 bp, Rattus norvegicus
tttagcactgacttctgacctgcga

SEQ ID NO: 688227 - DNA, 25 bp, Rattus norvegicus
tttagcagtcatcttctttccgcct

SEQ ID NO: 688228 - DNA, 25 bp, Rattus norvegicus
tttagcagtcatgttctttccgcct

SEQ ID NO: 688229 - DNA, 25 bp, Rattus norvegicus
tttagcagtctaagttggctcctgt

SEQ ID NO: 688230 - DNA, 25 bp, Rattus norvegicus
tttagcagtctatgttggctcctgt

SEQ ID NO: 688231 - DNA, 25 bp, Rattus norvegicus
tttagcatccagacggagcggcaga

SEQ ID NO: 688232 - DNA, 25 bp, Rattus norvegicus
tttagcatccagtcggagcggcaga

SEQ ID NO: 688233 - DNA, 25 bp, Rattus norvegicus
tttagcatccttctcttagactcta

SEQ ID NO: 688234 - DNA, 25 bp, Rattus norvegicus
tttagcatccttgtcttagactcta

SEQ ID NO: 688235 - DNA, 25 bp, Rattus norvegicus
tttagcatgaagcagccccaggcag

SEQ ID NO: 688236 - DNA, 25 bp, Rattus norvegicus
tttagcatgaaggagccccaggcag

SEQ ID NO: 688237 - DNA, 25 bp, Rattus norvegicus
tttagcatgagccacgtgctcgatc

SEQ ID NO: 688238 - DNA, 25 bp, Rattus norvegicus
tttagcatgagcgacgtgctcgatc

SEQ ID NO: 688239 - DNA, 25 bp, Rattus norvegicus
tttagcatgcacacatgcctttaat

SEQ ID NO: 688240 - DNA, 25 bp, Rattus norvegicus
tttagcatgcactcatgcctttaat

SEQ ID NO: 688241 - DNA, 25 bp, Rattus norvegicus
tttagcatgcataaggtcctaggtt

SEQ ID NO: 688242 - DNA, 25 bp, Rattus norvegicus
tttagcatgcattaggtcctaggtt

SEQ ID NO: 688243 - DNA, 25 bp, Rattus norvegicus
tttagcatggccctgcttacagaca

SEQ ID NO: 688244 - DNA, 25 bp, Rattus norvegicus
tttagcatggccgtgcttacagaca

SEQ ID NO: 688245 - DNA, 25 bp, Rattus norvegicus
tttagcattcacagttgcagcctcc

SEQ ID NO: 688246 - DNA, 25 bp, Rattus norvegicus
tttagcattcactgttgcagcctcc

SEQ ID NO: 688247 - DNA, 25 bp, Rattus norvegicus
tttagcattctacgtaattgacaga

SEQ ID NO: 688248 - DNA, 25 bp, Rattus norvegicus
tttagcattctaggtaattgacaga

SEQ ID NO: 688249 - DNA, 25 bp, Rattus norvegicus
tttagcattttccaggctttaaata

SEQ ID NO: 688250 - DNA, 25 bp, Rattus norvegicus
tttagcattttcgaggctttaaata

SEQ ID NO: 688251 - DNA, 25 bp, Rattus norvegicus
tttagccaacccaggcagttttgag

SEQ ID NO: 688252 - DNA, 25 bp, Rattus norvegicus
tttagccaaccctggcagttttgag

SEQ ID NO: 688253 - DNA, 25 bp, Rattus norvegicus
tttagccaactgatcctgctgtgta

SEQ ID NO: 688254 - DNA, 25 bp, Rattus norvegicus
tttagccaactgttcctgctgtgta

SEQ ID NO: 688255 - DNA, 25 bp, Rattus norvegicus
tttagccaagttctgtgttagtcac

SEQ ID NO: 688256 - DNA, 25 bp, Rattus norvegicus
tttagccaagttgtgtgttagtcac

SEQ ID NO: 688257 - DNA, 25 bp, Rattus norvegicus
tttagccagggcacgtaatacttgc

SEQ ID NO: 688258 - DNA, 25 bp, Rattus norvegicus
tttagccagggctcgtaatacttgc

SEQ ID NO: 688259 - DNA, 25 bp, Rattus norvegicus
tttagccagttccacaccatcacga

SEQ ID NO: 688260 - DNA, 25 bp, Rattus norvegicus
tttagccagttcgacaccatcacga

SEQ ID NO: 688261 - DNA, 25 bp, Rattus norvegicus
tttagccatgcacaaacggtagtct

SEQ ID NO: 688262 - DNA, 25 bp, Rattus norvegicus
tttagccatgcagaaacggtagtct

SEQ ID NO: 688263 - DNA, 25 bp, Rattus norvegicus
tttagccatgtgatgactctggacc

SEQ ID NO: 688264 - DNA, 25 bp, Rattus norvegicus
tttagccatgtgttgactctggacc

SEQ ID NO: 688265 - DNA, 25 bp, Rattus norvegicus
tttagcccaagcatacattcttcct

SEQ ID NO: 688266 - DNA, 25 bp, Rattus norvegicus
tttagcccaagcttacattcttcct

SEQ ID NO: 688267 - DNA, 25 bp, Rattus norvegicus
tttagcccaattatctatcccgact

SEQ ID NO: 688268 - DNA, 25 bp, Rattus norvegicus
tttagcccaattttctatcccgact

SEQ ID NO: 688269 - DNA, 25 bp, Rattus norvegicus
tttagcccaccactttgcctggttt

SEQ ID NO: 688270 - DNA, 25 bp, Rattus norvegicus
tttagcccaccagtttgcctggttt

SEQ ID NO: 688271 - DNA, 25 bp, Rattus norvegicus
tttagcccatcaaccaatgtttgta

SEQ ID NO: 688272 - DNA, 25 bp, Rattus norvegicus
tttagcccatcatccaatgtttgta

SEQ ID NO: 688273 - DNA, 25 bp, Rattus norvegicus
tttagcccattgagggaatccctga

SEQ ID NO: 688274 - DNA, 25 bp, Rattus norvegicus
tttagcccattgtgggaatccctga

SEQ ID NO: 688275 - DNA, 25 bp, Rattus norvegicus
tttagcccctttcgtatccagacct

SEQ ID NO: 688276 - DNA, 25 bp, Rattus norvegicus
tttagcccctttggtatccagacct

SEQ ID NO: 688277 - DNA, 25 bp, Rattus norvegicus
tttagcccgaccagagaggcttgag

SEQ ID NO: 688278 - DNA, 25 bp, Rattus norvegicus
tttagcccgacctgagaggcttgag

SEQ ID NO: 688279 - DNA, 25 bp, Rattus norvegicus
tttagccctagacccaccaaatggt

SEQ ID NO: 688280 - DNA, 25 bp, Rattus norvegicus
tttagccctagagccaccaaatggt

SEQ ID NO: 688281 - DNA, 25 bp, Rattus norvegicus
tttagccgcgtaactttatatctcc

SEQ ID NO: 688282 - DNA, 25 bp, Rattus norvegicus
tttagccgcgtatctttatatctcc

SEQ ID NO: 688283 - DNA, 25 bp, Rattus norvegicus
tttagccgtgggatggtttgctcta

SEQ ID NO: 688284 - DNA, 25 bp, Rattus norvegicus
tttagccgtgggttggtttgctcta

SEQ ID NO: 688285 - DNA, 25 bp, Rattus norvegicus
tttagcctactaacagaagtctttt

SEQ ID NO: 688286 - DNA, 25 bp, Rattus norvegicus
tttagcctactatcagaagtctttt

SEQ ID NO: 688287 - DNA, 25 bp, Rattus norvegicus
tttagcctcaagactttcaacctcg

SEQ ID NO: 688288 - DNA, 25 bp, Rattus norvegicus
tttagcctcaagtctttcaacctcg

SEQ ID NO: 688289 - DNA, 25 bp, Rattus norvegicus
tttagcctcgagacaccctgagaag

SEQ ID NO: 688290 - DNA, 25 bp, Rattus norvegicus
tttagcctcgagtcaccctgagaag

SEQ ID NO: 688291 - DNA, 25 bp, Rattus norvegicus
tttagcctcttcaagggacaggcac

SEQ ID NO: 688292 - DNA, 25 bp, Rattus norvegicus
tttagcctcttctagggacaggcac

SEQ ID NO: 688293 - DNA, 25 bp, Rattus norvegicus
tttagcctgattcccagtaaaccag

SEQ ID NO: 688294 - DNA, 25 bp, Rattus norvegicus
tttagcctgattgccagtaaaccag

SEQ ID NO: 688295 - DNA, 25 bp, Rattus norvegicus
tttagccttcacactagactctaga

SEQ ID NO: 688296 - DNA, 25 bp, Rattus norvegicus
tttagccttcactctagactctaga

SEQ ID NO: 688297 - DNA, 25 bp, Rattus norvegicus
tttagcgtacttacacagcgtgtat

SEQ ID NO: 688298 - DNA, 25 bp, Rattus norvegicus
tttagcgtactttcacagcgtgtat

SEQ ID NO: 688299 - DNA, 25 bp, Rattus norvegicus
tttagcgtgcctctcagcaggagaa

SEQ ID NO: 688300 - DNA, 25 bp, Rattus norvegicus
tttagcgtgcctgtcagcaggagaa

SEQ ID NO: 688301 - DNA, 25 bp, Rattus norvegicus
tttagcgttctcacttccaaacgtc

SEQ ID NO: 688302 - DNA, 25 bp, Rattus norvegicus
tttagcgttctctcttccaaacgtc

SEQ ID NO: 688303 - DNA, 25 bp, Rattus norvegicus
tttagctacctgctgccagtgctag

SEQ ID NO: 688304 - DNA, 25 bp, Rattus norvegicus
tttagctacctggtgccagtgctag

SEQ ID NO: 688305 - DNA, 25 bp, Rattus norvegicus
tttagctagggtacggcgggcacgg

SEQ ID NO: 688306 - DNA, 25 bp, Rattus norvegicus
tttagctagggttcggcgggcacgg

SEQ ID NO: 688307 - DNA, 25 bp, Rattus norvegicus
tttagctcaagcagtctgcctgaac

SEQ ID NO: 688308 - DNA, 25 bp, Rattus norvegicus
tttagctcaagctgtctgcctgaac

SEQ ID NO: 688309 - DNA, 25 bp, Rattus norvegicus
tttagctcacccacattatttgtag

SEQ ID NO: 688310 - DNA, 25 bp, Rattus norvegicus
tttagctcaccctcattatttgtag

SEQ ID NO: 688311 - DNA, 25 bp, Rattus norvegicus
tttagctccctacactctttaacag

SEQ ID NO: 688312 - DNA, 25 bp, Rattus norvegicus
tttagctccctagactctttaacag

SEQ ID NO: 688313 - DNA, 25 bp, Rattus norvegicus
tttagctcctttatgatacctctct

SEQ ID NO: 688314 - DNA, 25 bp, Rattus norvegicus
tttagctcctttttgatacctctct

SEQ ID NO: 688315 - DNA, 25 bp, Rattus norvegicus
tttagctctctgattggtatcccaa

SEQ ID NO: 688316 - DNA, 25 bp, Rattus norvegicus
tttagctctctgtttggtatcccaa

SEQ ID NO: 688317 - DNA, 25 bp, Rattus norvegicus
tttagctgacctcctacttactgtg

SEQ ID NO: 688318 - DNA, 25 bp, Rattus norvegicus
tttagctgacctgctacttactgtg

SEQ ID NO: 688319 - DNA, 25 bp, Rattus norvegicus
tttagctgcacaaatgaaaagttag

SEQ ID NO: 688320 - DNA, 25 bp, Rattus norvegicus
tttagctgcacatatgaaaagttag

SEQ ID NO: 688321 - DNA, 25 bp, Rattus norvegicus
tttagctgcagtcggtccttggagt

SEQ ID NO: 688322 - DNA, 25 bp, Rattus norvegicus
tttagctgcagtgggtccttggagt

SEQ ID NO: 688323 - DNA, 25 bp, Rattus norvegicus
tttagctgtataccgggtgtcctgc

SEQ ID NO: 688324 - DNA, 25 bp, Rattus norvegicus
tttagctgtatagcgggtgtcctgc

SEQ ID NO: 688325 - DNA, 25 bp, Rattus norvegicus
tttagctgtttgctttgtttgccct

SEQ ID NO: 688326 - DNA, 25 bp, Rattus norvegicus
tttagctgtttggtttgtttgccct

SEQ ID NO: 688327 - DNA, 25 bp, Rattus norvegicus
tttagcttaccgagttgaccagtct

SEQ ID NO: 688328 - DNA, 25 bp, Rattus norvegicus
tttagcttaccgtgttgaccagtct

SEQ ID NO: 688329 - DNA, 25 bp, Rattus norvegicus
tttagcttatttcttgtaccttgca

SEQ ID NO: 688330 - DNA, 25 bp, Rattus norvegicus
tttagcttatttgttgtaccttgca

SEQ ID NO: 688331 - DNA, 25 bp, Rattus norvegicus
tttagcttcccgatttgcttcaagg

SEQ ID NO: 688332 - DNA, 25 bp, Rattus norvegicus
tttagcttcccgttttgcttcaagg

SEQ ID NO: 688333 - DNA, 25 bp, Rattus norvegicus
tttagcttctaaacctgcgtcacag

SEQ ID NO: 688334 - DNA, 25 bp, Rattus norvegicus
tttagcttctaatcctgcgtcacag

SEQ ID NO: 688335 - DNA, 25 bp, Rattus norvegicus
tttagcttgtatcgcttctgtagtc

SEQ ID NO: 688336 - DNA, 25 bp, Rattus norvegicus
tttagcttgtatggcttctgtagtc

SEQ ID NO: 688337 - DNA, 25 bp, Rattus norvegicus
tttagctttaggattgctgtccctt

SEQ ID NO: 688338 - DNA, 25 bp, Rattus norvegicus
tttagctttaggtttgctgtccctt

SEQ ID NO: 688339 - DNA, 25 bp, Rattus norvegicus
tttagctttcccacaggaggtcaga

SEQ ID NO: 688340 - DNA, 25 bp, Rattus norvegicus
tttagctttccctcaggaggtcaga

SEQ ID NO: 688341 - DNA, 25 bp, Rattus norvegicus
tttagctttgtactctccctggaac

SEQ ID NO: 688342 - DNA, 25 bp, Rattus norvegicus
tttagctttgtagtctccctggaac

SEQ ID NO: 688343 - DNA, 25 bp, Rattus norvegicus
tttagcttttacaactctcactctc

SEQ ID NO: 688344 - DNA, 25 bp, Rattus norvegicus
tttagcttttactactctcactctc

SEQ ID NO: 688345 - DNA, 25 bp, Rattus norvegicus
tttaggaaatgccacaaacacccgt

SEQ ID NO: 688346 - DNA, 25 bp, Rattus norvegicus
tttaggaaatgcgacaaacacccgt

SEQ ID NO: 688347 - DNA, 25 bp, Rattus norvegicus
tttaggaactctccttgacccgact

SEQ ID NO: 688348 - DNA, 25 bp, Rattus norvegicus
tttaggaactctgcttgacccgact

SEQ ID NO: 688349 - DNA, 25 bp, Rattus norvegicus
tttaggaacttcaccccgatgagat

SEQ ID NO: 688350 - DNA, 25 bp, Rattus norvegicus
tttaggaacttctccccgatgagat

SEQ ID NO: 688351 - DNA, 25 bp, Rattus norvegicus
tttaggaagaccacctggctgcaga

SEQ ID NO: 688352 - DNA, 25 bp, Rattus norvegicus
tttaggaagacctcctggctgcaga

SEQ ID NO: 688353 - DNA, 25 bp, Rattus norvegicus
tttaggaagtataaacatccaccat

SEQ ID NO: 688354 - DNA, 25 bp, Rattus norvegicus
tttaggaagtattaacatccaccat

SEQ ID NO: 688355 - DNA, 25 bp, Rattus norvegicus
tttaggaagttactattggccgcat

SEQ ID NO: 688356 - DNA, 25 bp, Rattus norvegicus
tttaggaagttagtattggccgcat

SEQ ID NO: 688357 - DNA, 25 bp, Rattus norvegicus
tttaggaatccaccgatgcctcttg

SEQ ID NO: 688358 - DNA, 25 bp, Rattus norvegicus
tttaggaatccagcgatgcctcttg

SEQ ID NO: 688359 - DNA, 25 bp, Rattus norvegicus
tttaggaatcttcccttgcagcctc

SEQ ID NO: 688360 - DNA, 25 bp, Rattus norvegicus
tttaggaatcttgccttgcagcctc

SEQ ID NO: 688361 - DNA, 25 bp, Rattus norvegicus
tttaggactcttactagtcggcata

SEQ ID NO: 688362 - DNA, 25 bp, Rattus norvegicus
tttaggactctttctagtcggcata

SEQ ID NO: 688363 - DNA, 25 bp, Rattus norvegicus
tttaggatgcggaagcttgggtctt

SEQ ID NO: 688364 - DNA, 25 bp, Rattus norvegicus
tttaggatgcggtagcttgggtctt

SEQ ID NO: 688365 - DNA, 25 bp, Rattus norvegicus
tttaggatgtgtccgatgcctctct

SEQ ID NO: 688366 - DNA, 25 bp, Rattus norvegicus
tttaggatgtgtgcgatgcctctct

SEQ ID NO: 688367 - DNA, 25 bp, Rattus norvegicus
tttaggcaaagcacctcccttattg

SEQ ID NO: 688368 - DNA, 25 bp, Rattus norvegicus
tttaggcaaagctcctcccttattg

SEQ ID NO: 688369 - DNA, 25 bp, Rattus norvegicus
tttaggcacggacccagtgtcaact

SEQ ID NO: 688370 - DNA, 25 bp, Rattus norvegicus
tttaggcacggagccagtgtcaact

SEQ ID NO: 688371 - DNA, 25 bp, Rattus norvegicus
tttaggcatctacgtgaagctgtgt

SEQ ID NO: 688372 - DNA, 25 bp, Rattus norvegicus
tttaggcatctaggtgaagctgtgt

SEQ ID NO: 688373 - DNA, 25 bp, Rattus norvegicus
tttaggccacacatccacaaagaga

SEQ ID NO: 688374 - DNA, 25 bp, Rattus norvegicus
tttaggccacacttccacaaagaga

SEQ ID NO: 688375 - DNA, 25 bp, Rattus norvegicus
tttaggcccactctgaactcgctgt

SEQ ID NO: 688376 - DNA, 25 bp, Rattus norvegicus
tttaggcccactgtgaactcgctgt

SEQ ID NO: 688377 - DNA, 25 bp, Rattus norvegicus
tttaggcccctgagtgtaggccaca

SEQ ID NO: 688378 - DNA, 25 bp, Rattus norvegicus
tttaggcccctgtgtgtaggccaca

SEQ ID NO: 688379 - DNA, 25 bp, Rattus norvegicus
tttaggcctccaatttactctggtc

SEQ ID NO: 688380 - DNA, 25 bp, Rattus norvegicus
tttaggcctccacctcccagggaag

SEQ ID NO: 688381 - DNA, 25 bp, Rattus norvegicus
tttaggcctccagctcccagggaag

SEQ ID NO: 688382 - DNA, 25 bp, Rattus norvegicus
tttaggcctccattttactctggtc

SEQ ID NO: 688383 - DNA, 25 bp, Rattus norvegicus
tttaggcctgacatctacagagatg

SEQ ID NO: 688384 - DNA, 25 bp, Rattus norvegicus
tttaggcctgacttctacagagatg

SEQ ID NO: 688385 - DNA, 25 bp, Rattus norvegicus
tttaggcctgtgagtgaattcttac

SEQ ID NO: 688386 - DNA, 25 bp, Rattus norvegicus
tttaggcctgtgtgtgaattcttac

SEQ ID NO: 688387 - DNA, 25 bp, Rattus norvegicus
tttaggctctgtctcattgcatgat

SEQ ID NO: 688388 - DNA, 25 bp, Rattus norvegicus
tttaggctctgtgtcattgcatgat

SEQ ID NO: 688389 - DNA, 25 bp, Rattus norvegicus
tttaggctgtttatcttatatgtga

SEQ ID NO: 688390 - DNA, 25 bp, Rattus norvegicus
tttaggctgtttttcttatatgtga

SEQ ID NO: 688391 - DNA, 25 bp, Rattus norvegicus
tttaggcttgtaacacccacagaag

SEQ ID NO: 688392 - DNA, 25 bp, Rattus norvegicus
tttaggcttgtatcacccacagaag

SEQ ID NO: 688393 - DNA, 25 bp, Rattus norvegicus
tttaggctttggatcttgttgttcg

SEQ ID NO: 688394 - DNA, 25 bp, Rattus norvegicus
tttaggctttggttcttgttgttcg

SEQ ID NO: 688395 - DNA, 25 bp, Rattus norvegicus
tttagggactctcgaacattctgga

SEQ ID NO: 688396 - DNA, 25 bp, Rattus norvegicus
tttagggactctggaacattctgga

SEQ ID NO: 688397 - DNA, 25 bp, Rattus norvegicus
tttagggagaagctgacaagactgc

SEQ ID NO: 688398 - DNA, 25 bp, Rattus norvegicus
tttagggagaaggtgacaagactgc

SEQ ID NO: 688399 - DNA, 25 bp, Rattus norvegicus
tttagggatcacactggttggccat

SEQ ID NO: 688400 - DNA, 25 bp, Rattus norvegicus
tttagggatcactctggttggccat

SEQ ID NO: 688401 - DNA, 25 bp, Rattus norvegicus
tttagggcacccaggcctttctgta

SEQ ID NO: 688402 - DNA, 25 bp, Rattus norvegicus
tttagggcaccctggcctttctgta

SEQ ID NO: 688403 - DNA, 25 bp, Rattus norvegicus
tttagggcagccaccagagttatgg

SEQ ID NO: 688404 - DNA, 25 bp, Rattus norvegicus
tttagggcagcctccagagttatgg

SEQ ID NO: 688405 - DNA, 25 bp, Rattus norvegicus
tttagggcaggtactcttctgagga

SEQ ID NO: 688406 - DNA, 25 bp, Rattus norvegicus
tttagggcaggttctcttctgagga

SEQ ID NO: 688407 - DNA, 25 bp, Rattus norvegicus
tttagggccttcattgtgtatacag

SEQ ID NO: 688408 - DNA, 25 bp, Rattus norvegicus
tttagggccttctttgtgtatacag

SEQ ID NO: 688409 - DNA, 25 bp, Rattus norvegicus
tttagggctaaccagacgactcagt

SEQ ID NO: 688410 - DNA, 25 bp, Rattus norvegicus
tttagggctaacgagacgactcagt

SEQ ID NO: 688411 - DNA, 25 bp, Rattus norvegicus
tttagggcttcactgggatcaggca

SEQ ID NO: 688412 - DNA, 25 bp, Rattus norvegicus
tttagggcttcagtgggatcaggca

SEQ ID NO: 688413 - DNA, 25 bp, Rattus norvegicus
tttagggtaaatagttctccattat

SEQ ID NO: 688414 - DNA, 25 bp, Rattus norvegicus
tttagggtaaattgttctccattat

SEQ ID NO: 688415 - DNA, 25 bp, Rattus norvegicus
tttagggtgaccatcctggcaccaa

SEQ ID NO: 688416 - DNA, 25 bp, Rattus norvegicus
tttagggtgaccttcctggcaccaa

SEQ ID NO: 688417 - DNA, 25 bp, Rattus norvegicus
tttagggtgactcaggtggctatcc

SEQ ID NO: 688418 - DNA, 25 bp, Rattus norvegicus
tttagggtgactgaggtggctatcc

SEQ ID NO: 688419 - DNA, 25 bp, Rattus norvegicus
tttagggtgcccatacttcagaaag

SEQ ID NO: 688420 - DNA, 25 bp, Rattus norvegicus
tttagggtgcccttacttcagaaag

SEQ ID NO: 688421 - DNA, 25 bp, Rattus norvegicus
tttagggttcttcggtcagcccaca

SEQ ID NO: 688422 - DNA, 25 bp, Rattus norvegicus
tttagggttcttgggtcagcccaca

SEQ ID NO: 688423 - DNA, 25 bp, Rattus norvegicus
tttaggtaaggaaaactctcgtagt

SEQ ID NO: 688424 - DNA, 25 bp, Rattus norvegicus
tttaggtaaggataactctcgtagt

SEQ ID NO: 688425 - DNA, 25 bp, Rattus norvegicus
tttaggtcagacatggtagctcaca

SEQ ID NO: 688426 - DNA, 25 bp, Rattus norvegicus
tttaggtcagacttggtagctcaca

SEQ ID NO: 688427 - DNA, 25 bp, Rattus norvegicus
tttaggtcccctcaggtggcactgg

SEQ ID NO: 688428 - DNA, 25 bp, Rattus norvegicus
tttaggtcccctgaggtggcactgg

SEQ ID NO: 688429 - DNA, 25 bp, Rattus norvegicus
tttaggtccttgaccgggtgagagc

SEQ ID NO: 688430 - DNA, 25 bp, Rattus norvegicus
tttaggtccttgtccgggtgagagc

SEQ ID NO: 688431 - DNA, 25 bp, Rattus norvegicus
tttaggtctcagagcctgttaccca

SEQ ID NO: 688432 - DNA, 25 bp, Rattus norvegicus
tttaggtctcagtgcctgttaccca

SEQ ID NO: 688433 - DNA, 25 bp, Rattus norvegicus
tttaggtctcatagggtttccccag

SEQ ID NO: 688434 - DNA, 25 bp, Rattus norvegicus
tttaggtctcattgggtttccccag

SEQ ID NO: 688435 - DNA, 25 bp, Rattus norvegicus
tttaggtctcttcctgataccaact

SEQ ID NO: 688436 - DNA, 25 bp, Rattus norvegicus
tttaggtctcttgctgataccaact

SEQ ID NO: 688437 - DNA, 25 bp, Rattus norvegicus
tttaggtctgtcatcttaggccgtg

SEQ ID NO: 688438 - DNA, 25 bp, Rattus norvegicus
tttaggtctgtcttcttaggccgtg

SEQ ID NO: 688439 - DNA, 25 bp, Rattus norvegicus
tttaggtgagccactgttggccaaa

SEQ ID NO: 688440 - DNA, 25 bp, Rattus norvegicus
tttaggtgagcctctgttggccaaa

SEQ ID NO: 688441 - DNA, 25 bp, Rattus norvegicus
tttaggtggtcaacagacgcctggg

SEQ ID NO: 688442 - DNA, 25 bp, Rattus norvegicus
tttaggtggtcatcagacgcctggg

SEQ ID NO: 688443 - DNA, 25 bp, Rattus norvegicus
tttaggtgtgtcagttgtaactgat

SEQ ID NO: 688444 - DNA, 25 bp, Rattus norvegicus
tttaggtgtgtctgttgtaactgat

SEQ ID NO: 688445 - DNA, 25 bp, Rattus norvegicus
tttagtaaatgacgtggcccctgga

SEQ ID NO: 688446 - DNA, 25 bp, Rattus norvegicus
tttagtaaatgaggtggcccctgga

SEQ ID NO: 688447 - DNA, 25 bp, Rattus norvegicus
tttagtaacacgagtctccatctcc

SEQ ID NO: 688448 - DNA, 25 bp, Rattus norvegicus
tttagtaacacgtgtctccatctcc

SEQ ID NO: 688449 - DNA, 25 bp, Rattus norvegicus
tttagtaagcttaataatttcctct

SEQ ID NO: 688450 - DNA, 25 bp, Rattus norvegicus
tttagtaagctttataatttcctct

SEQ ID NO: 688451 - DNA, 25 bp, Rattus norvegicus
tttagtacacaaacggcatctggct

SEQ ID NO: 688452 - DNA, 25 bp, Rattus norvegicus
tttagtacacaatcggcatctggct

SEQ ID NO: 688453 - DNA, 25 bp, Rattus norvegicus
tttagtacactgaccctgtttgaag

SEQ ID NO: 688454 - DNA, 25 bp, Rattus norvegicus
tttagtacactgtccctgtttgaag

SEQ ID NO: 688455 - DNA, 25 bp, Rattus norvegicus
tttagtaccatcacagactctgaga

SEQ ID NO: 688456 - DNA, 25 bp, Rattus norvegicus
tttagtaccatctcagactctgaga

SEQ ID NO: 688457 - DNA, 25 bp, Rattus norvegicus
tttagtacccctatagccagaatct

SEQ ID NO: 688458 - DNA, 25 bp, Rattus norvegicus
tttagtacccctttagccagaatct

SEQ ID NO: 688459 - DNA, 25 bp, Rattus norvegicus
tttagtatccaaaccttgtgtggcc

SEQ ID NO: 688460 - DNA, 25 bp, Rattus norvegicus
tttagtatccaatccttgtgtggcc

SEQ ID NO: 688461 - DNA, 25 bp, Rattus norvegicus
tttagtatgtgcagtgccctggttc

SEQ ID NO: 688462 - DNA, 25 bp, Rattus norvegicus
tttagtatgtgctgtgccctggttc

SEQ ID NO: 688463 - DNA, 25 bp, Rattus norvegicus
tttagtatgtgtcagagccctggtt

SEQ ID NO: 688464 - DNA, 25 bp, Rattus norvegicus
tttagtatgtgtgagagccctggtt

SEQ ID NO: 688465 - DNA, 25 bp, Rattus norvegicus
tttagtcaacttagcttgtcccatt

SEQ ID NO: 688466 - DNA, 25 bp, Rattus norvegicus
tttagtcaactttgcttgtcccatt

SEQ ID NO: 688467 - DNA, 25 bp, Rattus norvegicus
tttagtcacaccaacagggacgccg

SEQ ID NO: 688468 - DNA, 25 bp, Rattus norvegicus
tttagtcacacctacagggacgccg

SEQ ID NO: 688469 - DNA, 25 bp, Rattus norvegicus
tttagtccaactccctgctggtcag

SEQ ID NO: 688470 - DNA, 25 bp, Rattus norvegicus
tttagtccaactgcctgctggtcag

SEQ ID NO: 688471 - DNA, 25 bp, Rattus norvegicus
tttagtccagcgagggcttcaggaa

SEQ ID NO: 688472 - DNA, 25 bp, Rattus norvegicus
tttagtccagcgtgggcttcaggaa

SEQ ID NO: 688473 - DNA, 25 bp, Rattus norvegicus
tttagtccatgtcccctacccattt

SEQ ID NO: 688474 - DNA, 25 bp, Rattus norvegicus
tttagtccatgtgccctacccattt

SEQ ID NO: 688475 - DNA, 25 bp, Rattus norvegicus
tttagtcccagccttaggatgcaga

SEQ ID NO: 688476 - DNA, 25 bp, Rattus norvegicus
tttagtcccagcgttaggatgcaga

SEQ ID NO: 688477 - DNA, 25 bp, Rattus norvegicus
tttagtcctagcactcggaggccag

SEQ ID NO: 688478 - DNA, 25 bp, Rattus norvegicus
tttagtcctagctctcggaggccag

SEQ ID NO: 688479 - DNA, 25 bp, Rattus norvegicus
tttagtccttttagctcctataagc

SEQ ID NO: 688480 - DNA, 25 bp, Rattus norvegicus
tttagtcctttttgctcctataagc

SEQ ID NO: 688481 - DNA, 25 bp, Rattus norvegicus
tttagtctcacactgtggcctaggt

SEQ ID NO: 688482 - DNA, 25 bp, Rattus norvegicus
tttagtctcacagtgtggcctaggt

SEQ ID NO: 688483 - DNA, 25 bp, Rattus norvegicus
tttagtctcgccatcaagctatgta

SEQ ID NO: 688484 - DNA, 25 bp, Rattus norvegicus
tttagtctcgccttcaagctatgta

SEQ ID NO: 688485 - DNA, 25 bp, Rattus norvegicus
tttagtctctttctcctcagttgac

SEQ ID NO: 688486 - DNA, 25 bp, Rattus norvegicus
tttagtctctttgtcctcagttgac

SEQ ID NO: 688487 - DNA, 25 bp, Rattus norvegicus
tttagtctggtcatcttagtgcttt

SEQ ID NO: 688488 - DNA, 25 bp, Rattus norvegicus
tttagtctggtcttcttagtgcttt

SEQ ID NO: 688489 - DNA, 25 bp, Rattus norvegicus
tttagtctggttccagctgaagcta

SEQ ID NO: 688490 - DNA, 25 bp, Rattus norvegicus
tttagtctggttgcagctgaagcta

SEQ ID NO: 688491 - DNA, 25 bp, Rattus norvegicus
tttagtctttcaccagaagctctcg

SEQ ID NO: 688492 - DNA, 25 bp, Rattus norvegicus
tttagtctttcacttctttgaagtc

SEQ ID NO: 688493 - DNA, 25 bp, Rattus norvegicus
tttagtctttcagcagaagctctcg

SEQ ID NO: 688494 - DNA, 25 bp, Rattus norvegicus
tttagtctttcagttctttgaagtc

SEQ ID NO: 688495 - DNA, 25 bp, Rattus norvegicus
tttagtctttccatgaaggcagaac

SEQ ID NO: 688496 - DNA, 25 bp, Rattus norvegicus
tttagtctttccttgaaggcagaac

SEQ ID NO: 688497 - DNA, 25 bp, Rattus norvegicus
tttagtctttggaggaccacccact

SEQ ID NO: 688498 - DNA, 25 bp, Rattus norvegicus
tttagtctttggctcagaatcccct

SEQ ID NO: 688499 - DNA, 25 bp, Rattus norvegicus
tttagtctttgggtcagaatcccct

SEQ ID NO: 688500 - DNA, 25 bp, Rattus norvegicus
tttagtctttggtggaccacccact

SEQ ID NO: 688501 - DNA, 25 bp, Rattus norvegicus
tttagtgaaggcctactatgggtag

SEQ ID NO: 688502 - DNA, 25 bp, Rattus norvegicus
tttagtgaaggcgtactatgggtag

SEQ ID NO: 688503 - DNA, 25 bp, Rattus norvegicus
tttagtgactttcttcaccctgtgg

SEQ ID NO: 688504 - DNA, 25 bp, Rattus norvegicus
tttagtgactttgttcaccctgtgg

SEQ ID NO: 688505 - DNA, 25 bp, Rattus norvegicus
tttagtgaggatccaaacccatgcc

SEQ ID NO: 688506 - DNA, 25 bp, Rattus norvegicus
tttagtgaggatgcaaacccatgcc

SEQ ID NO: 688507 - DNA, 25 bp, Rattus norvegicus
tttagtgcaaagaaccctcctcttt

SEQ ID NO: 688508 - DNA, 25 bp, Rattus norvegicus
tttagtgcaaagtaccctcctcttt

SEQ ID NO: 688509 - DNA, 25 bp, Rattus norvegicus
tttagtgcagggacagctcccagaa

SEQ ID NO: 688510 - DNA, 25 bp, Rattus norvegicus
tttagtgcagggtcagctcccagaa

SEQ ID NO: 688511 - DNA, 25 bp, Rattus norvegicus
tttagtgcatgcagccatcacggca

SEQ ID NO: 688512 - DNA, 25 bp, Rattus norvegicus
tttagtgcatgctgccatcacggca

SEQ ID NO: 688513 - DNA, 25 bp, Rattus norvegicus
tttagtgccctaattaacagcccct

SEQ ID NO: 688514 - DNA, 25 bp, Rattus norvegicus
tttagtgccctatttaacagcccct

SEQ ID NO: 688515 - DNA, 25 bp, Rattus norvegicus
tttagtggcgtacaggcgatgccca

SEQ ID NO: 688516 - DNA, 25 bp, Rattus norvegicus
tttagtggcgtagaggcgatgccca

SEQ ID NO: 688517 - DNA, 25 bp, Rattus norvegicus
tttagtggtactcgcccacagccca

SEQ ID NO: 688518 - DNA, 25 bp, Rattus norvegicus
tttagtggtactggcccacagccca

SEQ ID NO: 688519 - DNA, 25 bp, Rattus norvegicus
tttagtgtcaccagcatgatgtgat

SEQ ID NO: 688520 - DNA, 25 bp, Rattus norvegicus
tttagtgtcacctgcatgatgtgat

SEQ ID NO: 688521 - DNA, 25 bp, Rattus norvegicus
tttagtgtctccatgatgcatcctt

SEQ ID NO: 688522 - DNA, 25 bp, Rattus norvegicus
tttagtgtctccttgatgcatcctt

SEQ ID NO: 688523 - DNA, 25 bp, Rattus norvegicus
tttagtgtcttgagccaacttccaa

SEQ ID NO: 688524 - DNA, 25 bp, Rattus norvegicus
tttagtgtcttgtgccaacttccaa

SEQ ID NO: 688525 - DNA, 25 bp, Rattus norvegicus
tttagtgtgaggactgggaacccag

SEQ ID NO: 688526 - DNA, 25 bp, Rattus norvegicus
tttagtgtgaggtctgggaacccag

SEQ ID NO: 688527 - DNA, 25 bp, Rattus norvegicus
tttagtgtgctaaaaatctccaaag

SEQ ID NO: 688528 - DNA, 25 bp, Rattus norvegicus
tttagtgtgctataaatctccaaag

SEQ ID NO: 688529 - DNA, 25 bp, Rattus norvegicus
tttagttacacaaactccactgctc

SEQ ID NO: 688530 - DNA, 25 bp, Rattus norvegicus
tttagttacacatactccactgctc

SEQ ID NO: 688531 - DNA, 25 bp, Rattus norvegicus
tttagttacgtaacaacccgtggct

SEQ ID NO: 688532 - DNA, 25 bp, Rattus norvegicus
tttagttacgtatcaacccgtggct

SEQ ID NO: 688533 - DNA, 25 bp, Rattus norvegicus
tttagttactacatgcccctcttag

SEQ ID NO: 688534 - DNA, 25 bp, Rattus norvegicus
tttagttactacttgcccctcttag

SEQ ID NO: 688535 - DNA, 25 bp, Rattus norvegicus
tttagttcagcacgtaagaggccct

SEQ ID NO: 688536 - DNA, 25 bp, Rattus norvegicus
tttagttcagcaggtaagaggccct

SEQ ID NO: 688537 - DNA, 25 bp, Rattus norvegicus
tttagttcaggtattcttgatatta

SEQ ID NO: 688538 - DNA, 25 bp, Rattus norvegicus
tttagttcaggttttcttgatatta

SEQ ID NO: 688539 - DNA, 25 bp, Rattus norvegicus
tttagttcagtaccacttactcctg

SEQ ID NO: 688540 - DNA, 25 bp, Rattus norvegicus
tttagttcagtagcacttactcctg

SEQ ID NO: 688541 - DNA, 25 bp, Rattus norvegicus
tttagttccagcactcaacttgtgc

SEQ ID NO: 688542 - DNA, 25 bp, Rattus norvegicus
tttagttccagctctcaacttgtgc

SEQ ID NO: 688543 - DNA, 25 bp, Rattus norvegicus
tttagttccgtgacgtgtgtgataa

SEQ ID NO: 688544 - DNA, 25 bp, Rattus norvegicus
tttagttccgtgtcgtgtgtgataa

SEQ ID NO: 688545 - DNA, 25 bp, Rattus norvegicus
tttagttcctacattagtcgctcac

SEQ ID NO: 688546 - DNA, 25 bp, Rattus norvegicus
tttagttcctactttagtcgctcac

SEQ ID NO: 688547 - DNA, 25 bp, Rattus norvegicus
tttagttctctgcagtgagtatcac

SEQ ID NO: 688548 - DNA, 25 bp, Rattus norvegicus
tttagttctctggagtgagtatcac

SEQ ID NO: 688549 - DNA, 25 bp, Rattus norvegicus
tttagttcttccctgtcttcctagg

SEQ ID NO: 688550 - DNA, 25 bp, Rattus norvegicus
tttagttcttccgtgtcttcctagg

SEQ ID NO: 688551 - DNA, 25 bp, Rattus norvegicus
tttagttgacttagtgctcccacaa

SEQ ID NO: 688552 - DNA, 25 bp, Rattus norvegicus
tttagttgactttgtgctcccacaa

SEQ ID NO: 688553 - DNA, 25 bp, Rattus norvegicus
tttagttgccgtatttacaaatgag

SEQ ID NO: 688554 - DNA, 25 bp, Rattus norvegicus
tttagttgccgtttttacaaatgag

SEQ ID NO: 688555 - DNA, 25 bp, Rattus norvegicus
tttagttgggtaccgccatgtaaat

SEQ ID NO: 688556 - DNA, 25 bp, Rattus norvegicus
tttagttgggtagcgccatgtaaat

SEQ ID NO: 688557 - DNA, 25 bp, Rattus norvegicus
tttagtttacaacagctcagtgcaa

SEQ ID NO: 688558 - DNA, 25 bp, Rattus norvegicus
tttagtttacaagagctcagtgcaa

SEQ ID NO: 688559 - DNA, 25 bp, Rattus norvegicus
tttagtttacccacaaatgggatat

SEQ ID NO: 688560 - DNA, 25 bp, Rattus norvegicus
tttagtttaccctcaaatgggatat

SEQ ID NO: 688561 - DNA, 25 bp, Rattus norvegicus
tttagtttcctcagctcccctgtga

SEQ ID NO: 688562 - DNA, 25 bp, Rattus norvegicus
tttagtttcctctgctcccctgtga

SEQ ID NO: 688563 - DNA, 25 bp, Rattus norvegicus
tttagtttcctgagcttgaactgaa

SEQ ID NO: 688564 - DNA, 25 bp, Rattus norvegicus
tttagtttcctgtgcttgaactgaa

SEQ ID NO: 688565 - DNA, 25 bp, Rattus norvegicus
tttagtttgcagacctgtgtgcttc

SEQ ID NO: 688566 - DNA, 25 bp, Rattus norvegicus
tttagtttgcagtcctgtgtgcttc

SEQ ID NO: 688567 - DNA, 25 bp, Rattus norvegicus
tttagtttgcatcgctatctgcctg

SEQ ID NO: 688568 - DNA, 25 bp, Rattus norvegicus
tttagtttgcatggctatctgcctg

SEQ ID NO: 688569 - DNA, 25 bp, Rattus norvegicus
tttagttttgtaacctgtggcctgg

SEQ ID NO: 688570 - DNA, 25 bp, Rattus norvegicus
tttagttttgtatcctgtggcctgg

SEQ ID NO: 688571 - DNA, 25 bp, Rattus norvegicus
tttataaaaagtccacccctccaca

SEQ ID NO: 688572 - DNA, 25 bp, Rattus norvegicus
tttataaaaagtgcacccctccaca

SEQ ID NO: 688573 - DNA, 25 bp, Rattus norvegicus
tttataaactgtctgctgctgagct

SEQ ID NO: 688574 - DNA, 25 bp, Rattus norvegicus
tttataaactgtgtgctgctgagct

SEQ ID NO: 688575 - DNA, 25 bp, Rattus norvegicus
tttataaagaccagcttcccatcgg

SEQ ID NO: 688576 - DNA, 25 bp, Rattus norvegicus
tttataaagacctgcttcccatcgg

SEQ ID NO: 688577 - DNA, 25 bp, Rattus norvegicus
tttataaatccccacctcctggtca

SEQ ID NO: 688578 - DNA, 25 bp, Rattus norvegicus
tttataaatcccgacctcctggtca

SEQ ID NO: 688579 - DNA, 25 bp, Rattus norvegicus
tttataacactaaagcactagatac

SEQ ID NO: 688580 - DNA, 25 bp, Rattus norvegicus
tttataacactatagcactagatac

SEQ ID NO: 688581 - DNA, 25 bp, Rattus norvegicus
tttataagacccatttcacagcgcc

SEQ ID NO: 688582 - DNA, 25 bp, Rattus norvegicus
tttataagacccttttcacagcgcc

SEQ ID NO: 688583 - DNA, 25 bp, Rattus norvegicus
tttataagccatctgttagcactgc

SEQ ID NO: 688584 - DNA, 25 bp, Rattus norvegicus
tttataagccatgtgttagcactgc

SEQ ID NO: 688585 - DNA, 25 bp, Rattus norvegicus
tttataataccaagcaggacctaag

SEQ ID NO: 688586 - DNA, 25 bp, Rattus norvegicus
tttataataccatgcaggacctaag

SEQ ID NO: 688587 - DNA, 25 bp, Rattus norvegicus
tttatacactgtcacccatcaatgg

SEQ ID NO: 688588 - DNA, 25 bp, Rattus norvegicus
tttatacactgtgacccatcaatgg

SEQ ID NO: 688589 - DNA, 25 bp, Rattus norvegicus
tttatacactttccttcctcagaca

SEQ ID NO: 688590 - DNA, 25 bp, Rattus norvegicus
tttatacactttgcttcctcagaca

SEQ ID NO: 688591 - DNA, 25 bp, Rattus norvegicus
tttatacagggtcttccaggctagc

SEQ ID NO: 688592 - DNA, 25 bp, Rattus norvegicus
tttatacagggtgttccaggctagc

SEQ ID NO: 688593 - DNA, 25 bp, Rattus norvegicus
tttatacatccgagacagcgtttat

SEQ ID NO: 688594 - DNA, 25 bp, Rattus norvegicus
tttatacatccgtgacagcgtttat

SEQ ID NO: 688595 - DNA, 25 bp, Rattus norvegicus
tttataccccagcaacaagtgaata

SEQ ID NO: 688596 - DNA, 25 bp, Rattus norvegicus
tttataccccaggaacaagtgaata

SEQ ID NO: 688597 - DNA, 25 bp, Rattus norvegicus
tttataccccttagtgatcagagct

SEQ ID NO: 688598 - DNA, 25 bp, Rattus norvegicus
tttatacccctttgtgatcagagct

SEQ ID NO: 688599 - DNA, 25 bp, Rattus norvegicus
tttatacctgtgactggcctgaagc

SEQ ID NO: 688600 - DNA, 25 bp, Rattus norvegicus
tttatacctgtgtctggcctgaagc

SEQ ID NO: 688601 - DNA, 25 bp, Rattus norvegicus
tttatactctgcctgtgaaaggaag

SEQ ID NO: 688602 - DNA, 25 bp, Rattus norvegicus
tttatactctgcgtgtgaaaggaag

SEQ ID NO: 688603 - DNA, 25 bp, Rattus norvegicus
tttatactcttgctctttccatgta

SEQ ID NO: 688604 - DNA, 25 bp, Rattus norvegicus
tttatactcttggtctttccatgta

SEQ ID NO: 688605 - DNA, 25 bp, Rattus norvegicus
tttatactgtgtatccccatggaga

SEQ ID NO: 688606 - DNA, 25 bp, Rattus norvegicus
tttatactgtgtttccccatggaga

SEQ ID NO: 688607 - DNA, 25 bp, Rattus norvegicus
tttatagacttaaccttcccttcag

SEQ ID NO: 688608 - DNA, 25 bp, Rattus norvegicus
tttatagacttatccttcccttcag

SEQ ID NO: 688609 - DNA, 25 bp, Rattus norvegicus
tttatagagcacattatgggcctgt

SEQ ID NO: 688610 - DNA, 25 bp, Rattus norvegicus
tttatagagcactttatgggcctgt

SEQ ID NO: 688611 - DNA, 25 bp, Rattus norvegicus
tttatagagtggatccccagggccg

SEQ ID NO: 688612 - DNA, 25 bp, Rattus norvegicus
tttatagagtggttccccagggccg

SEQ ID NO: 688613 - DNA, 25 bp, Rattus norvegicus
tttatagcaaagctcggtgtcccgc

SEQ ID NO: 688614 - DNA, 25 bp, Rattus norvegicus
tttatagcaaaggtcggtgtcccgc

SEQ ID NO: 688615 - DNA, 25 bp, Rattus norvegicus
tttatagcctatatcttacatctaa

SEQ ID NO: 688616 - DNA, 25 bp, Rattus norvegicus
tttatagcctatttcttacatctaa

SEQ ID NO: 688617 - DNA, 25 bp, Rattus norvegicus
tttatagcctccatgatacgctcta

SEQ ID NO: 688618 - DNA, 25 bp, Rattus norvegicus
tttatagcctccttgatacgctcta

SEQ ID NO: 688619 - DNA, 25 bp, Rattus norvegicus
tttatagcctttcccctaaatcaag

SEQ ID NO: 688620 - DNA, 25 bp, Rattus norvegicus
tttatagcctttgccctaaatcaag

SEQ ID NO: 688621 - DNA, 25 bp, Rattus norvegicus
tttatagcgataccatcaactccct

SEQ ID NO: 688622 - DNA, 25 bp, Rattus norvegicus
tttatagcgatagcatcaactccct

SEQ ID NO: 688623 - DNA, 25 bp, Rattus norvegicus
tttatagctcaaactcctgctggag

SEQ ID NO: 688624 - DNA, 25 bp, Rattus norvegicus
tttatagctcaatctcctgctggag

SEQ ID NO: 688625 - DNA, 25 bp, Rattus norvegicus
tttatagcttgtatctgtccttacc

SEQ ID NO: 688626 - DNA, 25 bp, Rattus norvegicus
tttatagcttgtttctgtccttacc

SEQ ID NO: 688627 - DNA, 25 bp, Rattus norvegicus
tttatagggttactgccctggccct

SEQ ID NO: 688628 - DNA, 25 bp, Rattus norvegicus
tttatagggttagtgccctggccct

SEQ ID NO: 688629 - DNA, 25 bp, Rattus norvegicus
tttatagtaagcattccctacctgc

SEQ ID NO: 688630 - DNA, 25 bp, Rattus norvegicus
tttatagtaagctttccctacctgc

SEQ ID NO: 688631 - DNA, 25 bp, Rattus norvegicus
tttatagtcactcctgccatgtgcc

SEQ ID NO: 688632 - DNA, 25 bp, Rattus norvegicus
tttatagtcactgctgccatgtgcc

SEQ ID NO: 688633 - DNA, 25 bp, Rattus norvegicus
tttatagtgatcatctggagcagat

SEQ ID NO: 688634 - DNA, 25 bp, Rattus norvegicus
tttatagtgatcttctggagcagat

SEQ ID NO: 688635 - DNA, 25 bp, Rattus norvegicus
tttatatattctctgagcctttcct

SEQ ID NO: 688636 - DNA, 25 bp, Rattus norvegicus
tttatatattctgtgagcctttcct

SEQ ID NO: 688637 - DNA, 25 bp, Rattus norvegicus
tttatatcacctcgccgctgttcac

SEQ ID NO: 688638 - DNA, 25 bp, Rattus norvegicus
tttatatcacctggccgctgttcac

SEQ ID NO: 688639 - DNA, 25 bp, Rattus norvegicus
tttatatccacaatcccaaatccac

SEQ ID NO: 688640 - DNA, 25 bp, Rattus norvegicus
tttatatccacattcccaaatccac

SEQ ID NO: 688641 - DNA, 25 bp, Rattus norvegicus
tttatatccttcaccactctcaaag

SEQ ID NO: 688642 - DNA, 25 bp, Rattus norvegicus
tttatatccttctccactctcaaag

SEQ ID NO: 688643 - DNA, 25 bp, Rattus norvegicus
tttatatctcaaaccctgtagctcc

SEQ ID NO: 688644 - DNA, 25 bp, Rattus norvegicus
tttatatctcaatccctgtagctcc

SEQ ID NO: 688645 - DNA, 25 bp, Rattus norvegicus
tttatatctgctattgtttcaccaa

SEQ ID NO: 688646 - DNA, 25 bp, Rattus norvegicus
tttatatctgcttttgtttcaccaa

SEQ ID NO: 688647 - DNA, 25 bp, Rattus norvegicus
tttatatgcgatactcccgaagagg

SEQ ID NO: 688648 - DNA, 25 bp, Rattus norvegicus
tttatatgcgattctcccgaagagg

SEQ ID NO: 688649 - DNA, 25 bp, Rattus norvegicus
tttatatggctcaactgggcagaag

SEQ ID NO: 688650 - DNA, 25 bp, Rattus norvegicus
tttatatggctctactgggcagaag

SEQ ID NO: 688651 - DNA, 25 bp, Rattus norvegicus
tttatatgtgaaaatgcctaggctt

SEQ ID NO: 688652 - DNA, 25 bp, Rattus norvegicus
tttatatgtgaatatgcctaggctt

SEQ ID NO: 688653 - DNA, 25 bp, Rattus norvegicus
tttatattccccaagtctcaaacct

SEQ ID NO: 688654 - DNA, 25 bp, Rattus norvegicus
tttatattcccctagtctcaaacct

SEQ ID NO: 688655 - DNA, 25 bp, Rattus norvegicus
tttatattcctgagagatctcctga

SEQ ID NO: 688656 - DNA, 25 bp, Rattus norvegicus
tttatattcctgtgagatctcctga

SEQ ID NO: 688657 - DNA, 25 bp, Rattus norvegicus
tttatattctataccctttgctttg

SEQ ID NO: 688658 - DNA, 25 bp, Rattus norvegicus
tttatattctattccctttgctttg

SEQ ID NO: 688659 - DNA, 25 bp, Rattus norvegicus
tttatattttcaacactccagagct

SEQ ID NO: 688660 - DNA, 25 bp, Rattus norvegicus
tttatattttcatcactccagagct

SEQ ID NO: 688661 - DNA, 25 bp, Rattus norvegicus
tttatattttgcatgtcttcccgtc

SEQ ID NO: 688662 - DNA, 25 bp, Rattus norvegicus
tttatattttgcttgtcttcccgtc

SEQ ID NO: 688663 - DNA, 25 bp, Rattus norvegicus
tttatcaaaagcagggcccctttca

SEQ ID NO: 688664 - DNA, 25 bp, Rattus norvegicus
tttatcaaaagctgggcccctttca

SEQ ID NO: 688665 - DNA, 25 bp, Rattus norvegicus
tttatcaaatgcattaccccaggct

SEQ ID NO: 688666 - DNA, 25 bp, Rattus norvegicus
tttatcaaatgctttaccccaggct

SEQ ID NO: 688667 - DNA, 25 bp, Rattus norvegicus
tttatcaacagcctcaagttctcca

SEQ ID NO: 688668 - DNA, 25 bp, Rattus norvegicus
tttatcaacagcgtcaagttctcca

SEQ ID NO: 688669 - DNA, 25 bp, Rattus norvegicus
tttatcacacttaaaggccaagggt

SEQ ID NO: 688670 - DNA, 25 bp, Rattus norvegicus
tttatcacactttaaggccaagggt

SEQ ID NO: 688671 - DNA, 25 bp, Rattus norvegicus
tttatcacagctctgatcccagcat

SEQ ID NO: 688672 - DNA, 25 bp, Rattus norvegicus
tttatcacagctgtgatcccagcat

SEQ ID NO: 688673 - DNA, 25 bp, Rattus norvegicus
tttatcaccaagcagaagccctgga

SEQ ID NO: 688674 - DNA, 25 bp, Rattus norvegicus
tttatcaccaaggagaagccctgga

SEQ ID NO: 688675 - DNA, 25 bp, Rattus norvegicus
tttatcaccagtcgtttccaggcca

SEQ ID NO: 688676 - DNA, 25 bp, Rattus norvegicus
tttatcaccagtggtttccaggcca

SEQ ID NO: 688677 - DNA, 25 bp, Rattus norvegicus
tttatcactaccacttttaggcctg

SEQ ID NO: 688678 - DNA, 25 bp, Rattus norvegicus
tttatcactacctcttttaggcctg

SEQ ID NO: 688679 - DNA, 25 bp, Rattus norvegicus
tttatcacttacctgcaggccaagc

SEQ ID NO: 688680 - DNA, 25 bp, Rattus norvegicus
tttatcacttacgtgcaggccaagc

SEQ ID NO: 688681 - DNA, 25 bp, Rattus norvegicus
tttatcagatcaaccacccaatgtg

SEQ ID NO: 688682 - DNA, 25 bp, Rattus norvegicus
tttatcagatcatccacccaatgtg

SEQ ID NO: 688683 - DNA, 25 bp, Rattus norvegicus
tttatcagcccacttctatttgcag

SEQ ID NO: 688684 - DNA, 25 bp, Rattus norvegicus
tttatcagcccagttctatttgcag

SEQ ID NO: 688685 - DNA, 25 bp, Rattus norvegicus
tttatcagtagacgctggactccct

SEQ ID NO: 688686 - DNA, 25 bp, Rattus norvegicus
tttatcagtagaggctggactccct

SEQ ID NO: 688687 - DNA, 25 bp, Rattus norvegicus
tttatcagtctcaagtcagcaggcc

SEQ ID NO: 688688 - DNA, 25 bp, Rattus norvegicus
tttatcagtctctagtcagcaggcc

SEQ ID NO: 688689 - DNA, 25 bp, Rattus norvegicus
tttatcagtggtctacgaaatccct

SEQ ID NO: 688690 - DNA, 25 bp, Rattus norvegicus
tttatcagtggtgtacgaaatccct

SEQ ID NO: 688691 - DNA, 25 bp, Rattus norvegicus
tttatcatcacgagaaacttgaatg

SEQ ID NO: 688692 - DNA, 25 bp, Rattus norvegicus
tttatcatcacgtgaaacttgaatg

SEQ ID NO: 688693 - DNA, 25 bp, Rattus norvegicus
tttatcatccccaggacattcttac

SEQ ID NO: 688694 - DNA, 25 bp, Rattus norvegicus
tttatcatcccctggacattcttac

SEQ ID NO: 688695 - DNA, 25 bp, Rattus norvegicus
tttatcattcgcaggaacttgcatt

SEQ ID NO: 688696 - DNA, 25 bp, Rattus norvegicus
tttatcattcgctggaacttgcatt

SEQ ID NO: 688697 - DNA, 25 bp, Rattus norvegicus
tttatccagacaagagggccatgct

SEQ ID NO: 688698 - DNA, 25 bp, Rattus norvegicus
tttatccagacatgagggccatgct

SEQ ID NO: 688699 - DNA, 25 bp, Rattus norvegicus
tttatccaggacacatgatgctctg

SEQ ID NO: 688700 - DNA, 25 bp, Rattus norvegicus
tttatccaggactcatgatgctctg

SEQ ID NO: 688701 - DNA, 25 bp, Rattus norvegicus
tttatccagtgaccatctttccagg

SEQ ID NO: 688702 - DNA, 25 bp, Rattus norvegicus
tttatccagtgagcatctttccagg

SEQ ID NO: 688703 - DNA, 25 bp, Rattus norvegicus
tttatcccaattcctagagcctgct

SEQ ID NO: 688704 - DNA, 25 bp, Rattus norvegicus
tttatcccaattgctagagcctgct

SEQ ID NO: 688705 - DNA, 25 bp, Rattus norvegicus
tttatcccactcaaacccatctggt

SEQ ID NO: 688706 - DNA, 25 bp, Rattus norvegicus
tttatcccactctaacccatctggt

SEQ ID NO: 688707 - DNA, 25 bp, Rattus norvegicus
tttatcccaggcatagcttttgaga

SEQ ID NO: 688708 - DNA, 25 bp, Rattus norvegicus
tttatcccaggccttggtccaggaa

SEQ ID NO: 688709 - DNA, 25 bp, Rattus norvegicus
tttatcccaggcgttggtccaggaa

SEQ ID NO: 688710 - DNA, 25 bp, Rattus norvegicus
tttatcccaggcttagcttttgaga

SEQ ID NO: 688711 - DNA, 25 bp, Rattus norvegicus
tttatcccatctcacacatgcatgt

SEQ ID NO: 688712 - DNA, 25 bp, Rattus norvegicus
tttatcccatctgacacatgcatgt

SEQ ID NO: 688713 - DNA, 25 bp, Rattus norvegicus
tttatccccactcctggaatatttt

SEQ ID NO: 688714 - DNA, 25 bp, Rattus norvegicus
tttatccccactgctggaatatttt

SEQ ID NO: 688715 - DNA, 25 bp, Rattus norvegicus
tttatccccgtgagtacctgtggac

SEQ ID NO: 688716 - DNA, 25 bp, Rattus norvegicus
tttatccccgtgtgtacctgtggac

SEQ ID NO: 688717 - DNA, 25 bp, Rattus norvegicus
tttatcccctctcgaaagttccttg

SEQ ID NO: 688718 - DNA, 25 bp, Rattus norvegicus
tttatcccctctggaaagttccttg

SEQ ID NO: 688719 - DNA, 25 bp, Rattus norvegicus
tttatcccctgcatgactctgtaaa

SEQ ID NO: 688720 - DNA, 25 bp, Rattus norvegicus
tttatcccctgcttgactctgtaaa

SEQ ID NO: 688721 - DNA, 25 bp, Rattus norvegicus
tttatccgagtcacccagcaagtga

SEQ ID NO: 688722 - DNA, 25 bp, Rattus norvegicus
tttatccgagtctcccagcaagtga

SEQ ID NO: 688723 - DNA, 25 bp, Rattus norvegicus
tttatcctagtaactcagtgttcat

SEQ ID NO: 688724 - DNA, 25 bp, Rattus norvegicus
tttatcctagtatctcagtgttcat

SEQ ID NO: 688725 - DNA, 25 bp, Rattus norvegicus
tttatcctcataatcgtacctcaag

SEQ ID NO: 688726 - DNA, 25 bp, Rattus norvegicus
tttatcctcatattcgtacctcaag

SEQ ID NO: 688727 - DNA, 25 bp, Rattus norvegicus
tttatcctccatccggcaacattat

SEQ ID NO: 688728 - DNA, 25 bp, Rattus norvegicus
tttatcctccatgcggcaacattat

SEQ ID NO: 688729 - DNA, 25 bp, Rattus norvegicus
tttatcctccttatataccacatcc

SEQ ID NO: 688730 - DNA, 25 bp, Rattus norvegicus
tttatcctccttttataccacatcc

SEQ ID NO: 688731 - DNA, 25 bp, Rattus norvegicus
tttatcctcggtcttttggctctga

SEQ ID NO: 688732 - DNA, 25 bp, Rattus norvegicus
tttatcctcggtgttttggctctga

SEQ ID NO: 688733 - DNA, 25 bp, Rattus norvegicus
tttatcctcttgaatcctctacgaa

SEQ ID NO: 688734 - DNA, 25 bp, Rattus norvegicus
tttatcctcttgtatcctctacgaa

SEQ ID NO: 688735 - DNA, 25 bp, Rattus norvegicus
tttatcctgacaatacacccaatca

SEQ ID NO: 688736 - DNA, 25 bp, Rattus norvegicus
tttatcctgacattacacccaatca

SEQ ID NO: 688737 - DNA, 25 bp, Rattus norvegicus
tttatcctgctgaaaactatatata

SEQ ID NO: 688738 - DNA, 25 bp, Rattus norvegicus
tttatcctgctgtaaactatatata

SEQ ID NO: 688739 - DNA, 25 bp, Rattus norvegicus
tttatcctgttaaaccaagatccta

SEQ ID NO: 688740 - DNA, 25 bp, Rattus norvegicus
tttatcctgttataccaagatccta

SEQ ID NO: 688741 - DNA, 25 bp, Rattus norvegicus
tttatccttacactcatcagctggg

SEQ ID NO: 688742 - DNA, 25 bp, Rattus norvegicus
tttatccttacagtcatcagctggg

SEQ ID NO: 688743 - DNA, 25 bp, Rattus norvegicus
tttatccttgggatgagtcagtccc

SEQ ID NO: 688744 - DNA, 25 bp, Rattus norvegicus
tttatccttgggttgagtcagtccc

SEQ ID NO: 688745 - DNA, 25 bp, Rattus norvegicus
tttatcgaccgccacaaacagctgc

SEQ ID NO: 688746 - DNA, 25 bp, Rattus norvegicus
tttatcgaccgcgacaaacagctgc

SEQ ID NO: 688747 - DNA, 25 bp, Rattus norvegicus
tttatcgattccctcccagagcata

SEQ ID NO: 688748 - DNA, 25 bp, Rattus norvegicus
tttatcgattccgtcccagagcata

SEQ ID NO: 688749 - DNA, 25 bp, Rattus norvegicus
tttatcgcaccacaatagcaccaaa

SEQ ID NO: 688750 - DNA, 25 bp, Rattus norvegicus
tttatcgcaccagaatagcaccaaa

SEQ ID NO: 688751 - DNA, 25 bp, Rattus norvegicus
tttatctcacatagcctggacaacc

SEQ ID NO: 688752 - DNA, 25 bp, Rattus norvegicus
tttatctcacattgcctggacaacc

SEQ ID NO: 688753 - DNA, 25 bp, Rattus norvegicus
tttatctcccaaattcttatatatt

SEQ ID NO: 688754 - DNA, 25 bp, Rattus norvegicus
tttatctcccaatttcttatatatt

SEQ ID NO: 688755 - DNA, 25 bp, Rattus norvegicus
tttatctcgaacagcatagccaccc

SEQ ID NO: 688756 - DNA, 25 bp, Rattus norvegicus
tttatctcgaactgcatagccaccc

SEQ ID NO: 688757 - DNA, 25 bp, Rattus norvegicus
tttatctcgttaaaggtctgcccct

SEQ ID NO: 688758 - DNA, 25 bp, Rattus norvegicus
tttatctcgttataggtctgcccct

SEQ ID NO: 688759 - DNA, 25 bp, Rattus norvegicus
tttatctcgtttccccaatgtcact

SEQ ID NO: 688760 - DNA, 25 bp, Rattus norvegicus
tttatctcgtttgcccaatgtcact

SEQ ID NO: 688761 - DNA, 25 bp, Rattus norvegicus
tttatctctaagactcctagtttga

SEQ ID NO: 688762 - DNA, 25 bp, Rattus norvegicus
tttatctctaagtctcctagtttga

SEQ ID NO: 688763 - DNA, 25 bp, Rattus norvegicus
tttatctctgtaccagctttcctga

SEQ ID NO: 688764 - DNA, 25 bp, Rattus norvegicus
tttatctctgtagcagctttcctga

SEQ ID NO: 688765 - DNA, 25 bp, Rattus norvegicus
tttatctctttccatatgacctctt

SEQ ID NO: 688766 - DNA, 25 bp, Rattus norvegicus
tttatctctttcgatatgacctctt

SEQ ID NO: 688767 - DNA, 25 bp, Rattus norvegicus
tttatctgcaatcatggcagctttc

SEQ ID NO: 688768 - DNA, 25 bp, Rattus norvegicus
tttatctgcaatgatggcagctttc

SEQ ID NO: 688769 - DNA, 25 bp, Rattus norvegicus
tttatctgggaccagcacgatggct

SEQ ID NO: 688770 - DNA, 25 bp, Rattus norvegicus
tttatctgggacgagcacgatggct

SEQ ID NO: 688771 - DNA, 25 bp, Rattus norvegicus
tttatctgtactccatgggccgaaa

SEQ ID NO: 688772 - DNA, 25 bp, Rattus norvegicus
tttatctgtactgcatgggccgaaa

SEQ ID NO: 688773 - DNA, 25 bp, Rattus norvegicus
tttatctgtcagatcgtctctccca

SEQ ID NO: 688774 - DNA, 25 bp, Rattus norvegicus
tttatctgtcagttcgtctctccca

SEQ ID NO: 688775 - DNA, 25 bp, Rattus norvegicus
tttatctgtcccaacatgggtggaa

SEQ ID NO: 688776 - DNA, 25 bp, Rattus norvegicus
tttatctgtccctacatgggtggaa

SEQ ID NO: 688777 - DNA, 25 bp, Rattus norvegicus
tttatcttaccaactgctctcagag

SEQ ID NO: 688778 - DNA, 25 bp, Rattus norvegicus
tttatcttaccatctgctctcagag

SEQ ID NO: 688779 - DNA, 25 bp, Rattus norvegicus
tttatcttatctaggagggcagttt

SEQ ID NO: 688780 - DNA, 25 bp, Rattus norvegicus
tttatcttatcttggagggcagttt

SEQ ID NO: 688781 - DNA, 25 bp, Rattus norvegicus
tttatcttcacccaggctgtacaat

SEQ ID NO: 688782 - DNA, 25 bp, Rattus norvegicus
tttatcttcaccgaggctgtacaat

SEQ ID NO: 688783 - DNA, 25 bp, Rattus norvegicus
tttatcttgaccatgatgttccaaa

SEQ ID NO: 688784 - DNA, 25 bp, Rattus norvegicus
tttatcttgaccttgatgttccaaa

SEQ ID NO: 688785 - DNA, 25 bp, Rattus norvegicus
tttatcttgtaaacctcatggccct

SEQ ID NO: 688786 - DNA, 25 bp, Rattus norvegicus
tttatcttgtaatcctcatggccct

SEQ ID NO: 688787 - DNA, 25 bp, Rattus norvegicus
tttatctttcttaggcatggcttca

SEQ ID NO: 688788 - DNA, 25 bp, Rattus norvegicus
tttatctttctttggcatggcttca

SEQ ID NO: 688789 - DNA, 25 bp, Rattus norvegicus
tttatcttttatagcaagtgcccat

SEQ ID NO: 688790 - DNA, 25 bp, Rattus norvegicus
tttatcttttattgcaagtgcccat

SEQ ID NO: 688791 - DNA, 25 bp, Rattus norvegicus
tttatctttttcaagggccctcgct

SEQ ID NO: 688792 - DNA, 25 bp, Rattus norvegicus
tttatctttttctagggccctcgct

SEQ ID NO: 688793 - DNA, 25 bp, Rattus norvegicus
tttatgaaaatcaccactgtgctag

SEQ ID NO: 688794 - DNA, 25 bp, Rattus norvegicus
tttatgaaaatctccactgtgctag

SEQ ID NO: 688795 - DNA, 25 bp, Rattus norvegicus
tttatgaagcggcagtcctccgtga

SEQ ID NO: 688796 - DNA, 25 bp, Rattus norvegicus
tttatgaagcgggagtcctccgtga

SEQ ID NO: 688797 - DNA, 25 bp, Rattus norvegicus
tttatgaaggatcactccatcccct

SEQ ID NO: 688798 - DNA, 25 bp, Rattus norvegicus
tttatgaaggatgactccatcccct

SEQ ID NO: 688799 - DNA, 25 bp, Rattus norvegicus
tttatgaaggtgcttaagcgcccac

SEQ ID NO: 688800 - DNA, 25 bp, Rattus norvegicus
tttatgaaggtggttaagcgcccac

SEQ ID NO: 688801 - DNA, 25 bp, Rattus norvegicus
tttatgaatcccaaccccaaactga

SEQ ID NO: 688802 - DNA, 25 bp, Rattus norvegicus
tttatgaatccctaccccaaactga

SEQ ID NO: 688803 - DNA, 25 bp, Rattus norvegicus
tttatgagatgtagctttcacttct

SEQ ID NO: 688804 - DNA, 25 bp, Rattus norvegicus
tttatgagatgttgctttcacttct

SEQ ID NO: 688805 - DNA, 25 bp, Rattus norvegicus
tttatgaggatgaccagtgtcttgc

SEQ ID NO: 688806 - DNA, 25 bp, Rattus norvegicus
tttatgaggatgtccagtgtcttgc

SEQ ID NO: 688807 - DNA, 25 bp, Rattus norvegicus
tttatgagtcaacccagtctgatct

SEQ ID NO: 688808 - DNA, 25 bp, Rattus norvegicus
tttatgagtcaagccagtctgatct

SEQ ID NO: 688809 - DNA, 25 bp, Rattus norvegicus
tttatgatgcctatgggctctgtct

SEQ ID NO: 688810 - DNA, 25 bp, Rattus norvegicus
tttatgatgcctttgggctctgtct

SEQ ID NO: 688811 - DNA, 25 bp, Rattus norvegicus
tttatgatttccctccataccattg

SEQ ID NO: 688812 - DNA, 25 bp, Rattus norvegicus
tttatgatttccgtccataccattg

SEQ ID NO: 688813 - DNA, 25 bp, Rattus norvegicus
tttatgcaacgtcagccagctgttc

SEQ ID NO: 688814 - DNA, 25 bp, Rattus norvegicus
tttatgcaacgtgagccagctgttc

SEQ ID NO: 688815 - DNA, 25 bp, Rattus norvegicus
tttatgcacttacaggcccgtgtac

SEQ ID NO: 688816 - DNA, 25 bp, Rattus norvegicus
tttatgcacttagaggcccgtgtac

SEQ ID NO: 688817 - DNA, 25 bp, Rattus norvegicus
tttatgccccatatatcatgtgtgc

SEQ ID NO: 688818 - DNA, 25 bp, Rattus norvegicus
tttatgccccatttatcatgtgtgc

SEQ ID NO: 688819 - DNA, 25 bp, Rattus norvegicus
tttatgccggtaatcccaatctgga

SEQ ID NO: 688820 - DNA, 25 bp, Rattus norvegicus
tttatgccggtattcccaatctgga

SEQ ID NO: 688821 - DNA, 25 bp, Rattus norvegicus
tttatgcctggccattgcatttagt

SEQ ID NO: 688822 - DNA, 25 bp, Rattus norvegicus
tttatgcctggcgattgcatttagt

SEQ ID NO: 688823 - DNA, 25 bp, Rattus norvegicus
tttatgcgcgagcaactgagccagc

SEQ ID NO: 688824 - DNA, 25 bp, Rattus norvegicus
tttatgcgcgaggaactgagccagc

SEQ ID NO: 688825 - DNA, 25 bp, Rattus norvegicus
tttatgctctatctaatccaggctg

SEQ ID NO: 688826 - DNA, 25 bp, Rattus norvegicus
tttatgctctatgtaatccaggctg

SEQ ID NO: 688827 - DNA, 25 bp, Rattus norvegicus
tttatgctgaccagttcctaacctt

SEQ ID NO: 688828 - DNA, 25 bp, Rattus norvegicus
tttatgctgacctgttcctaacctt

SEQ ID NO: 688829 - DNA, 25 bp, Rattus norvegicus
tttatgctgagtaggccttgagctc

SEQ ID NO: 688830 - DNA, 25 bp, Rattus norvegicus
tttatgctgagttggccttgagctc

SEQ ID NO: 688831 - DNA, 25 bp, Rattus norvegicus
tttatgcttaaaatgttacaaggtt

SEQ ID NO: 688832 - DNA, 25 bp, Rattus norvegicus
tttatgcttaaattgttacaaggtt

SEQ ID NO: 688833 - DNA, 25 bp, Rattus norvegicus
tttatggacatcacaccagagtgtg

SEQ ID NO: 688834 - DNA, 25 bp, Rattus norvegicus
tttatggacatctcaccagagtgtg

SEQ ID NO: 688835 - DNA, 25 bp, Rattus norvegicus
tttatggagcctaggcaggcccaga

SEQ ID NO: 688836 - DNA, 25 bp, Rattus norvegicus
tttatggagccttggcaggcccaga

SEQ ID NO: 688837 - DNA, 25 bp, Rattus norvegicus
tttatggaggccctaaacatcagcc

SEQ ID NO: 688838 - DNA, 25 bp, Rattus norvegicus
tttatggaggccgtaaacatcagcc

SEQ ID NO: 688839 - DNA, 25 bp, Rattus norvegicus
tttatggatgacaccagccgctcta

SEQ ID NO: 688840 - DNA, 25 bp, Rattus norvegicus
tttatggatgactccagccgctcta

SEQ ID NO: 688841 - DNA, 25 bp, Rattus norvegicus
tttatggccatgaacacgttctgac

SEQ ID NO: 688842 - DNA, 25 bp, Rattus norvegicus
tttatggccatgtacacgttctgac

SEQ ID NO: 688843 - DNA, 25 bp, Rattus norvegicus
tttatggcctggcttcagctctgcc

SEQ ID NO: 688844 - DNA, 25 bp, Rattus norvegicus
tttatggcctgggttcagctctgcc

SEQ ID NO: 688845 - DNA, 25 bp, Rattus norvegicus
tttatggctcctctatttgttgtgg

SEQ ID NO: 688846 - DNA, 25 bp, Rattus norvegicus
tttatggctcctgtatttgttgtgg

SEQ ID NO: 688847 - DNA, 25 bp, Rattus norvegicus
tttatggctgggatgctcggatcaa

SEQ ID NO: 688848 - DNA, 25 bp, Rattus norvegicus
tttatggctgggttgctcggatcaa

SEQ ID NO: 688849 - DNA, 25 bp, Rattus norvegicus
tttatgggagcaacattgtgtggtc

SEQ ID NO: 688850 - DNA, 25 bp, Rattus norvegicus
tttatgggagcatcattgtgtggtc

SEQ ID NO: 688851 - DNA, 25 bp, Rattus norvegicus
tttatgggtcccagccatggacaaa

SEQ ID NO: 688852 - DNA, 25 bp, Rattus norvegicus
tttatgggtccctgccatggacaaa

SEQ ID NO: 688853 - DNA, 25 bp, Rattus norvegicus
tttatgggtttgattccgaggtgac

SEQ ID NO: 688854 - DNA, 25 bp, Rattus norvegicus
tttatgggtttgtttccgaggtgac

SEQ ID NO: 688855 - DNA, 25 bp, Rattus norvegicus
tttatggtaattcttgctcgtctat

SEQ ID NO: 688856 - DNA, 25 bp, Rattus norvegicus
tttatggtaattgttgctcgtctat

SEQ ID NO: 688857 - DNA, 25 bp, Rattus norvegicus
tttatggtcaggaagcctagccacc

SEQ ID NO: 688858 - DNA, 25 bp, Rattus norvegicus
tttatggtcaggtagcctagccacc

SEQ ID NO: 688859 - DNA, 25 bp, Rattus norvegicus
tttatggtgacgattgcttcctcta

SEQ ID NO: 688860 - DNA, 25 bp, Rattus norvegicus
tttatggtgacgtttgcttcctcta

SEQ ID NO: 688861 - DNA, 25 bp, Rattus norvegicus
tttatggtgcacatctatgccacag

SEQ ID NO: 688862 - DNA, 25 bp, Rattus norvegicus
tttatggtgcacttctatgccacag

SEQ ID NO: 688863 - DNA, 25 bp, Rattus norvegicus
tttatggtgccaagtagcctacatt

SEQ ID NO: 688864 - DNA, 25 bp, Rattus norvegicus
tttatggtgccatgtagcctacatt

SEQ ID NO: 688865 - DNA, 25 bp, Rattus norvegicus
tttatggttcttcccacagtgacat

SEQ ID NO: 688866 - DNA, 25 bp, Rattus norvegicus
tttatggttcttgccacagtgacat

SEQ ID NO: 688867 - DNA, 25 bp, Rattus norvegicus
tttatgtcacctattgctttccgag

SEQ ID NO: 688868 - DNA, 25 bp, Rattus norvegicus
tttatgtcaccttttgctttccgag

SEQ ID NO: 688869 - DNA, 25 bp, Rattus norvegicus
tttatgtcagttagccctagtcctt

SEQ ID NO: 688870 - DNA, 25 bp, Rattus norvegicus
tttatgtcagtttgccctagtcctt

SEQ ID NO: 688871 - DNA, 25 bp, Rattus norvegicus
tttatgtccaggcttgccctgcaag

SEQ ID NO: 688872 - DNA, 25 bp, Rattus norvegicus
tttatgtccagggttgccctgcaag

SEQ ID NO: 688873 - DNA, 25 bp, Rattus norvegicus
tttatgtgacatcgcctggtttccg

SEQ ID NO: 688874 - DNA, 25 bp, Rattus norvegicus
tttatgtgacatggcctggtttccg

SEQ ID NO: 688875 - DNA, 25 bp, Rattus norvegicus
tttatgtggctcataggtccctccg

SEQ ID NO: 688876 - DNA, 25 bp, Rattus norvegicus
tttatgtggctcttaggtccctccg

SEQ ID NO: 688877 - DNA, 25 bp, Rattus norvegicus
tttatgtggcttaagctccagtccc

SEQ ID NO: 688878 - DNA, 25 bp, Rattus norvegicus
tttatgtggctttagctccagtccc

SEQ ID NO: 688879 - DNA, 25 bp, Rattus norvegicus
tttatgtggtgccttattaccctcc

SEQ ID NO: 688880 - DNA, 25 bp, Rattus norvegicus
tttatgtggtgcgttattaccctcc

SEQ ID NO: 688881 - DNA, 25 bp, Rattus norvegicus
tttatgtgtattccttcctgttctc

SEQ ID NO: 688882 - DNA, 25 bp, Rattus norvegicus
tttatgtgtattgcttcctgttctc

SEQ ID NO: 688883 - DNA, 25 bp, Rattus norvegicus
tttatgtgtggtacttgaaactgtt

SEQ ID NO: 688884 - DNA, 25 bp, Rattus norvegicus
tttatgtgtggttcttgaaactgtt

SEQ ID NO: 688885 - DNA, 25 bp, Rattus norvegicus
tttatgttcacacatctgcgcacaa

SEQ ID NO: 688886 - DNA, 25 bp, Rattus norvegicus
tttatgttcacagatctgcgcacaa

SEQ ID NO: 688887 - DNA, 25 bp, Rattus norvegicus
tttatgttccatctccgtgttttgt

SEQ ID NO: 688888 - DNA, 25 bp, Rattus norvegicus
tttatgttccatgtccgtgttttgt

SEQ ID NO: 688889 - DNA, 25 bp, Rattus norvegicus
tttatgttgtgcaattcctggtcca

SEQ ID NO: 688890 - DNA, 25 bp, Rattus norvegicus
tttatgttgtgctattcctggtcca

SEQ ID NO: 688891 - DNA, 25 bp, Rattus norvegicus
tttattaaggctctcactcatcaag

SEQ ID NO: 688892 - DNA, 25 bp, Rattus norvegicus
tttattaaggctgtcactcatcaag

SEQ ID NO: 688893 - DNA, 25 bp, Rattus norvegicus
tttattaatcaaccagtcccctgtc

SEQ ID NO: 688894 - DNA, 25 bp, Rattus norvegicus
tttattaatcaagcagtcccctgtc

SEQ ID NO: 688895 - DNA, 25 bp, Rattus norvegicus
tttattacacttcctttttcctgag

SEQ ID NO: 688896 - DNA, 25 bp, Rattus norvegicus
tttattacacttgctttttcctgag

SEQ ID NO: 688897 - DNA, 25 bp, Rattus norvegicus
tttattacagtaattcgcttagcga

SEQ ID NO: 688898 - DNA, 25 bp, Rattus norvegicus
tttattacagtatttcgcttagcga

SEQ ID NO: 688899 - DNA, 25 bp, Rattus norvegicus
tttattacccacaccttctgatgag

SEQ ID NO: 688900 - DNA, 25 bp, Rattus norvegicus
tttattacccactccttctgatgag

SEQ ID NO: 688901 - DNA, 25 bp, Rattus norvegicus
tttattacggaaactcgccgctact

SEQ ID NO: 688902 - DNA, 25 bp, Rattus norvegicus
tttattacggaatctcgccgctact

SEQ ID NO: 688903 - DNA, 25 bp, Rattus norvegicus
tttattactagacctcaaccacagc

SEQ ID NO: 688904 - DNA, 25 bp, Rattus norvegicus
tttattactagagctcaaccacagc

SEQ ID NO: 688905 - DNA, 25 bp, Rattus norvegicus
tttattactttactgtccctgggct

SEQ ID NO: 688906 - DNA, 25 bp, Rattus norvegicus
tttattactttagtgtccctgggct

SEQ ID NO: 688907 - DNA, 25 bp, Rattus norvegicus
tttattagagccctgagagcttggg

SEQ ID NO: 688908 - DNA, 25 bp, Rattus norvegicus
tttattagagccgtgagagcttggg

SEQ ID NO: 688909 - DNA, 25 bp, Rattus norvegicus
tttattagatcaaagctgcccttgg

SEQ ID NO: 688910 - DNA, 25 bp, Rattus norvegicus
tttattagatcatagctgcccttgg

SEQ ID NO: 688911 - DNA, 25 bp, Rattus norvegicus
tttattagccagcaccagatgcatg

SEQ ID NO: 688912 - DNA, 25 bp, Rattus norvegicus
tttattagccaggaccagatgcatg

SEQ ID NO: 688913 - DNA, 25 bp, Rattus norvegicus
tttattaggctcatctgttccccac

SEQ ID NO: 688914 - DNA, 25 bp, Rattus norvegicus
tttattaggctcttctgttccccac

SEQ ID NO: 688915 - DNA, 25 bp, Rattus norvegicus
tttattatgaatctgcctggctcct

SEQ ID NO: 688916 - DNA, 25 bp, Rattus norvegicus
tttattatgaatgtgcctggctcct

SEQ ID NO: 688917 - DNA, 25 bp, Rattus norvegicus
tttattattcacatctttcacacag

SEQ ID NO: 688918 - DNA, 25 bp, Rattus norvegicus
tttattattcacttctttcacacag

SEQ ID NO: 688919 - DNA, 25 bp, Rattus norvegicus
tttattatttgcataccagcccctc

SEQ ID NO: 688920 - DNA, 25 bp, Rattus norvegicus
tttattatttgcttaccagcccctc

SEQ ID NO: 688921 - DNA, 25 bp, Rattus norvegicus
tttattcacctgacagtaagcctga

SEQ ID NO: 688922 - DNA, 25 bp, Rattus norvegicus
tttattcacctgtcagtaagcctga

SEQ ID NO: 688923 - DNA, 25 bp, Rattus norvegicus
tttattcagactcgtccacattccc

SEQ ID NO: 688924 - DNA, 25 bp, Rattus norvegicus
tttattcagactggtccacattccc

SEQ ID NO: 688925 - DNA, 25 bp, Rattus norvegicus
tttattcagctactccacttctgga

SEQ ID NO: 688926 - DNA, 25 bp, Rattus norvegicus
tttattcagctagtccacttctgga

SEQ ID NO: 688927 - DNA, 25 bp, Rattus norvegicus
tttattcatggcaaagtgtcagttt

SEQ ID NO: 688928 - DNA, 25 bp, Rattus norvegicus
tttattcatggctaagtgtcagttt

SEQ ID NO: 688929 - DNA, 25 bp, Rattus norvegicus
tttattcattgtctctagggtggaa

SEQ ID NO: 688930 - DNA, 25 bp, Rattus norvegicus
tttattcattgtgtctagggtggaa

SEQ ID NO: 688931 - DNA, 25 bp, Rattus norvegicus
tttattccctgcaaaagaaacagtc

SEQ ID NO: 688932 - DNA, 25 bp, Rattus norvegicus
tttattccctgctaaagaaacagtc

SEQ ID NO: 688933 - DNA, 25 bp, Rattus norvegicus
tttattcctatgaacgagtccgtcg

SEQ ID NO: 688934 - DNA, 25 bp, Rattus norvegicus
tttattcctatgtacgagtccgtcg

SEQ ID NO: 688935 - DNA, 25 bp, Rattus norvegicus
tttattcctcggaccttgtaattgg

SEQ ID NO: 688936 - DNA, 25 bp, Rattus norvegicus
tttattcctcggtccttgtaattgg

SEQ ID NO: 688937 - DNA, 25 bp, Rattus norvegicus
tttattcctggtccatctctttttg

SEQ ID NO: 688938 - DNA, 25 bp, Rattus norvegicus
tttattcctggtgcatctctttttg

SEQ ID NO: 688939 - DNA, 25 bp, Rattus norvegicus
tttattctccttaattctggtttga

SEQ ID NO: 688940 - DNA, 25 bp, Rattus norvegicus
tttattctcctttattctggtttga

SEQ ID NO: 688941 - DNA, 25 bp, Rattus norvegicus
tttattctcgataacaagcagagcc

SEQ ID NO: 688942 - DNA, 25 bp, Rattus norvegicus
tttattctcgattacaagcagagcc

SEQ ID NO: 688943 - DNA, 25 bp, Rattus norvegicus
tttattctctctattgcggcctctc

SEQ ID NO: 688944 - DNA, 25 bp, Rattus norvegicus
tttattctctcttttgcggcctctc

SEQ ID NO: 688945 - DNA, 25 bp, Rattus norvegicus
tttattctgcttacacttccaggtc

SEQ ID NO: 688946 - DNA, 25 bp, Rattus norvegicus
tttattctgctttcacttccaggtc

SEQ ID NO: 688947 - DNA, 25 bp, Rattus norvegicus
tttattctgggccactctactactt

SEQ ID NO: 688948 - DNA, 25 bp, Rattus norvegicus
tttattctgggcgactctactactt

SEQ ID NO: 688949 - DNA, 25 bp, Rattus norvegicus
tttattcttattatcttgtggtcca

SEQ ID NO: 688950 - DNA, 25 bp, Rattus norvegicus
tttattcttattttcttgtggtcca

SEQ ID NO: 688951 - DNA, 25 bp, Rattus norvegicus
tttattcttgacaagctacagcggg

SEQ ID NO: 688952 - DNA, 25 bp, Rattus norvegicus
tttattcttgactagctacagcggg

SEQ ID NO: 688953 - DNA, 25 bp, Rattus norvegicus
tttattctttaaatccccacttctg

SEQ ID NO: 688954 - DNA, 25 bp, Rattus norvegicus
tttattctttaattccccacttctg

SEQ ID NO: 688955 - DNA, 25 bp, Rattus norvegicus
tttattctttgtctagcctcctcat

SEQ ID NO: 688956 - DNA, 25 bp, Rattus norvegicus
tttattctttgtgtagcctcctcat

SEQ ID NO: 688957 - DNA, 25 bp, Rattus norvegicus
tttattcttttaactcggcaaatgg

SEQ ID NO: 688958 - DNA, 25 bp, Rattus norvegicus
tttattcttttatctcggcaaatgg

SEQ ID NO: 688959 - DNA, 25 bp, Rattus norvegicus
tttattgaccccacattgtacctaa

SEQ ID NO: 688960 - DNA, 25 bp, Rattus norvegicus
tttattgacccctcattgtacctaa

SEQ ID NO: 688961 - DNA, 25 bp, Rattus norvegicus
tttattgacttcagggtgcttctgt

SEQ ID NO: 688962 - DNA, 25 bp, Rattus norvegicus
tttattgacttctgggtgcttctgt

SEQ ID NO: 688963 - DNA, 25 bp, Rattus norvegicus
tttattgagtttccctcatcctggg

SEQ ID NO: 688964 - DNA, 25 bp, Rattus norvegicus
tttattgagtttgcctcatcctggg

SEQ ID NO: 688965 - DNA, 25 bp, Rattus norvegicus
tttattgatcaaactctgcgggtgg

SEQ ID NO: 688966 - DNA, 25 bp, Rattus norvegicus
tttattgatcaatctctgcgggtgg

SEQ ID NO: 688967 - DNA, 25 bp, Rattus norvegicus
tttattgcacaactcaggatccctg

SEQ ID NO: 688968 - DNA, 25 bp, Rattus norvegicus
tttattgcacaagtcaggatccctg

SEQ ID NO: 688969 - DNA, 25 bp, Rattus norvegicus
tttattgcagacattttgtccagca

SEQ ID NO: 688970 - DNA, 25 bp, Rattus norvegicus
tttattgcagactttttgtccagca

SEQ ID NO: 688971 - DNA, 25 bp, Rattus norvegicus
tttattgcagagacacagggcacct

SEQ ID NO: 688972 - DNA, 25 bp, Rattus norvegicus
tttattgcagagtcacagggcacct

SEQ ID NO: 688973 - DNA, 25 bp, Rattus norvegicus
tttattgcagggaaacctctaaaag

SEQ ID NO: 688974 - DNA, 25 bp, Rattus norvegicus
tttattgcagggtaacctctaaaag

SEQ ID NO: 688975 - DNA, 25 bp, Rattus norvegicus
tttattgcccataaacctgtgacag

SEQ ID NO: 688976 - DNA, 25 bp, Rattus norvegicus
tttattgcccattaacctgtgacag

SEQ ID NO: 688977 - DNA, 25 bp, Rattus norvegicus
tttattgcctgtatctttcccgtgt

SEQ ID NO: 688978 - DNA, 25 bp, Rattus norvegicus
tttattgcctgtttctttcccgtgt

SEQ ID NO: 688979 - DNA, 25 bp, Rattus norvegicus
tttattgcctttcttccccctgagc

SEQ ID NO: 688980 - DNA, 25 bp, Rattus norvegicus
tttattgcctttgttccccctgagc

SEQ ID NO: 688981 - DNA, 25 bp, Rattus norvegicus
tttattgcgcatcccagtacagtaa

SEQ ID NO: 688982 - DNA, 25 bp, Rattus norvegicus
tttattgcgcatgccagtacagtaa

SEQ ID NO: 688983 - DNA, 25 bp, Rattus norvegicus
tttattggaagcaccatcttggttt

SEQ ID NO: 688984 - DNA, 25 bp, Rattus norvegicus
tttattggaagctccatcttggttt

SEQ ID NO: 688985 - DNA, 25 bp, Rattus norvegicus
tttattgggtggactcgcagcagaa

SEQ ID NO: 688986 - DNA, 25 bp, Rattus norvegicus
tttattgggtggtctcgcagcagaa

SEQ ID NO: 688987 - DNA, 25 bp, Rattus norvegicus
tttattggtgatcatctcctcgccc

SEQ ID NO: 688988 - DNA, 25 bp, Rattus norvegicus
tttattggtgatgatctcctcgccc

SEQ ID NO: 688989 - DNA, 25 bp, Rattus norvegicus
tttattggtgtacagcctccatgct

SEQ ID NO: 688990 - DNA, 25 bp, Rattus norvegicus
tttattggtgtaccctctctttgtt

SEQ ID NO: 688991 - DNA, 25 bp, Rattus norvegicus
tttattggtgtagagcctccatgct

SEQ ID NO: 688992 - DNA, 25 bp, Rattus norvegicus
tttattggtgtagcctctctttgtt

SEQ ID NO: 688993 - DNA, 25 bp, Rattus norvegicus
tttattggtttgactcctgagctac

SEQ ID NO: 688994 - DNA, 25 bp, Rattus norvegicus
tttattggtttgtctcctgagctac

SEQ ID NO: 688995 - DNA, 25 bp, Rattus norvegicus
tttattgtaattcccagctcccact

SEQ ID NO: 688996 - DNA, 25 bp, Rattus norvegicus
tttattgtaattgccagctcccact

SEQ ID NO: 688997 - DNA, 25 bp, Rattus norvegicus
tttattgtcacactcataatgctga

SEQ ID NO: 688998 - DNA, 25 bp, Rattus norvegicus
tttattgtcacagtcataatgctga

SEQ ID NO: 688999 - DNA, 25 bp, Rattus norvegicus
tttattgtccttctaattcctcata

SEQ ID NO: 689000 - DNA, 25 bp, Rattus norvegicus
tttattgtccttgtaattcctcata

SEQ ID NO: 689001 - DNA, 25 bp, Rattus norvegicus
tttattgtgctgagcctggtcctaa

SEQ ID NO: 689002 - DNA, 25 bp, Rattus norvegicus
tttattgtgctgatatcttctgtgt

SEQ ID NO: 689003 - DNA, 25 bp, Rattus norvegicus
tttattgtgctgtgcctggtcctaa

SEQ ID NO: 689004 - DNA, 25 bp, Rattus norvegicus
tttattgtgctgttatcttctgtgt

SEQ ID NO: 689005 - DNA, 25 bp, Rattus norvegicus
tttattgtgtttacacctttgcagt

SEQ ID NO: 689006 - DNA, 25 bp, Rattus norvegicus
tttattgtgttttcacctttgcagt

SEQ ID NO: 689007 - DNA, 25 bp, Rattus norvegicus
tttattgttgatccggtagccaccc

SEQ ID NO: 689008 - DNA, 25 bp, Rattus norvegicus
tttattgttgatgcggtagccaccc

SEQ ID NO: 689009 - DNA, 25 bp, Rattus norvegicus
tttatttaacctctcatcgtacctg

SEQ ID NO: 689010 - DNA, 25 bp, Rattus norvegicus
tttatttaacctgtcatcgtacctg

SEQ ID NO: 689011 - DNA, 25 bp, Rattus norvegicus
tttatttacaggctgctctcagtcc

SEQ ID NO: 689012 - DNA, 25 bp, Rattus norvegicus
tttatttacagggtgctctcagtcc

SEQ ID NO: 689013 - DNA, 25 bp, Rattus norvegicus
tttatttaccaccttccacaggagt

SEQ ID NO: 689014 - DNA, 25 bp, Rattus norvegicus
tttatttaccacgttccacaggagt

SEQ ID NO: 689015 - DNA, 25 bp, Rattus norvegicus
tttatttaccttaaactcctgtgag

SEQ ID NO: 689016 - DNA, 25 bp, Rattus norvegicus
tttatttacctttaactcctgtgag

SEQ ID NO: 689017 - DNA, 25 bp, Rattus norvegicus
tttatttatgcacgtcaggtgactc

SEQ ID NO: 689018 - DNA, 25 bp, Rattus norvegicus
tttatttatgcaggtcaggtgactc

SEQ ID NO: 689019 - DNA, 25 bp, Rattus norvegicus
tttatttatggaagcctaggcttca

SEQ ID NO: 689020 - DNA, 25 bp, Rattus norvegicus
tttatttatggatgcctaggcttca

SEQ ID NO: 689021 - DNA, 25 bp, Rattus norvegicus
tttatttcaatgaagcttattttca

SEQ ID NO: 689022 - DNA, 25 bp, Rattus norvegicus
tttatttcaatgtagcttattttca

SEQ ID NO: 689023 - DNA, 25 bp, Rattus norvegicus
tttatttcacaaacaggaccagctg

SEQ ID NO: 689024 - DNA, 25 bp, Rattus norvegicus
tttatttcacaatcaggaccagctg

SEQ ID NO: 689025 - DNA, 25 bp, Rattus norvegicus
tttatttcacggattctcaacccat

SEQ ID NO: 689026 - DNA, 25 bp, Rattus norvegicus
tttatttcacggtttctcaacccat

SEQ ID NO: 689027 - DNA, 25 bp, Rattus norvegicus
tttatttccaaaaccagttctcaat

SEQ ID NO: 689028 - DNA, 25 bp, Rattus norvegicus
tttatttccaaatccagttctcaat

SEQ ID NO: 689029 - DNA, 25 bp, Rattus norvegicus
tttatttcccacctattaatgctcc

SEQ ID NO: 689030 - DNA, 25 bp, Rattus norvegicus
tttatttcccacgtattaatgctcc

SEQ ID NO: 689031 - DNA, 25 bp, Rattus norvegicus
tttatttcccctagatccagatgaa

SEQ ID NO: 689032 - DNA, 25 bp, Rattus norvegicus
tttatttccccttgatccagatgaa

SEQ ID NO: 689033 - DNA, 25 bp, Rattus norvegicus
tttatttccttcacgaaacagtctc

SEQ ID NO: 689034 - DNA, 25 bp, Rattus norvegicus
tttatttccttctcgaaacagtctc

SEQ ID NO: 689035 - DNA, 25 bp, Rattus norvegicus
tttatttccttgagtaccctggcag

SEQ ID NO: 689036 - DNA, 25 bp, Rattus norvegicus
tttatttccttgtgtaccctggcag

SEQ ID NO: 689037 - DNA, 25 bp, Rattus norvegicus
tttatttctataccttctttctaga

SEQ ID NO: 689038 - DNA, 25 bp, Rattus norvegicus
tttatttctatagcttctttctaga

SEQ ID NO: 689039 - DNA, 25 bp, Rattus norvegicus
tttatttctctacctaccctggacc

SEQ ID NO: 689040 - DNA, 25 bp, Rattus norvegicus
tttatttctctagctaccctggacc

SEQ ID NO: 689041 - DNA, 25 bp, Rattus norvegicus
tttatttctctgagaatcctggttc

SEQ ID NO: 689042 - DNA, 25 bp, Rattus norvegicus
tttatttctctgtgaatcctggttc

SEQ ID NO: 689043 - DNA, 25 bp, Rattus norvegicus
tttatttctgcacggctgaaagcac

SEQ ID NO: 689044 - DNA, 25 bp, Rattus norvegicus
tttatttctgcagggctgaaagcac

SEQ ID NO: 689045 - DNA, 25 bp, Rattus norvegicus
tttatttggtcgcatttccctgcaa

SEQ ID NO: 689046 - DNA, 25 bp, Rattus norvegicus
tttatttggtcggatttccctgcaa

SEQ ID NO: 689047 - DNA, 25 bp, Rattus norvegicus
tttatttgtagtcctctctacctgt

SEQ ID NO: 689048 - DNA, 25 bp, Rattus norvegicus
tttatttgtagtgctctctacctgt

SEQ ID NO: 689049 - DNA, 25 bp, Rattus norvegicus
tttatttgtgtaccgtccctttgat

SEQ ID NO: 689050 - DNA, 25 bp, Rattus norvegicus
tttatttgtgtagcgtccctttgat

SEQ ID NO: 689051 - DNA, 25 bp, Rattus norvegicus
tttatttgttccaatccttcccacg

SEQ ID NO: 689052 - DNA, 25 bp, Rattus norvegicus
tttatttgttcctatccttcccacg

SEQ ID NO: 689053 - DNA, 25 bp, Rattus norvegicus
tttatttgttgcagtgacctcttca

SEQ ID NO: 689054 - DNA, 25 bp, Rattus norvegicus
tttatttgttgctgtgacctcttca

SEQ ID NO: 689055 - DNA, 25 bp, Rattus norvegicus
tttattttacgtatttgacccactg

SEQ ID NO: 689056 - DNA, 25 bp, Rattus norvegicus
tttattttacgtttttgacccactg

SEQ ID NO: 689057 - DNA, 25 bp, Rattus norvegicus
tttattttactgagggaagaagcta

SEQ ID NO: 689058 - DNA, 25 bp, Rattus norvegicus
tttattttactgtgggaagaagcta

SEQ ID NO: 689059 - DNA, 25 bp, Rattus norvegicus
tttattttcagtattgcagcacaga

SEQ ID NO: 689060 - DNA, 25 bp, Rattus norvegicus
tttattttcagttttgcagcacaga

SEQ ID NO: 689061 - DNA, 25 bp, Rattus norvegicus
tttattttccaacccaccgtttctg

SEQ ID NO: 689062 - DNA, 25 bp, Rattus norvegicus
tttattttccaagccaccgtttctg

SEQ ID NO: 689063 - DNA, 25 bp, Rattus norvegicus
tttattttcctcaatcctcacaaac

SEQ ID NO: 689064 - DNA, 25 bp, Rattus norvegicus
tttattttcctctatcctcacaaac

SEQ ID NO: 689065 - DNA, 25 bp, Rattus norvegicus
tttattttctctaatctgtcacaaa

SEQ ID NO: 689066 - DNA, 25 bp, Rattus norvegicus
tttattttctcttatctgtcacaaa

SEQ ID NO: 689067 - DNA, 25 bp, Rattus norvegicus
tttattttctgaccacgcctcccgg

SEQ ID NO: 689068 - DNA, 25 bp, Rattus norvegicus
tttattttctgagcacgcctcccgg

SEQ ID NO: 689069 - DNA, 25 bp, Rattus norvegicus
tttattttgaagacagccgcactgg

SEQ ID NO: 689070 - DNA, 25 bp, Rattus norvegicus
tttattttgaagtcagccgcactgg

SEQ ID NO: 689071 - DNA, 25 bp, Rattus norvegicus
tttattttgcttctccttatctctg

SEQ ID NO: 689072 - DNA, 25 bp, Rattus norvegicus
tttattttgcttgtccttatctctg

SEQ ID NO: 689073 - DNA, 25 bp, Rattus norvegicus
tttatttttcaaatgctctgtcact

SEQ ID NO: 689074 - DNA, 25 bp, Rattus norvegicus
tttatttttcaattgctctgtcact

SEQ ID NO: 689075 - DNA, 25 bp, Rattus norvegicus
tttatttttcccaagtgactcctct

SEQ ID NO: 689076 - DNA, 25 bp, Rattus norvegicus
tttatttttccctagtgactcctct

SEQ ID NO: 689077 - DNA, 25 bp, Rattus norvegicus
tttatttttgcgcttcagctcgttc

SEQ ID NO: 689078 - DNA, 25 bp, Rattus norvegicus
tttatttttgcggttcagctcgttc

SEQ ID NO: 689079 - DNA, 25 bp, Rattus norvegicus
tttatttttgtaagcctccactcac

SEQ ID NO: 689080 - DNA, 25 bp, Rattus norvegicus
tttatttttgtatgcctccactcac

SEQ ID NO: 689081 - DNA, 25 bp, Rattus norvegicus
tttattttttcacaggacacctttg

SEQ ID NO: 689082 - DNA, 25 bp, Rattus norvegicus
tttattttttcagaggacacctttg

SEQ ID NO: 689083 - DNA, 25 bp, Rattus norvegicus
tttcaaaaacaaactccgcctcagt

SEQ ID NO: 689084 - DNA, 25 bp, Rattus norvegicus
tttcaaaaacaatctccgcctcagt

SEQ ID NO: 689085 - DNA, 25 bp, Rattus norvegicus
tttcaaaaccctatccaggagagtg

SEQ ID NO: 689086 - DNA, 25 bp, Rattus norvegicus
tttcaaaaccctttccaggagagtg

SEQ ID NO: 689087 - DNA, 25 bp, Rattus norvegicus
tttcaaaagcatacctgcctccttt

SEQ ID NO: 689088 - DNA, 25 bp, Rattus norvegicus
tttcaaaagcattcctgcctccttt

SEQ ID NO: 689089 - DNA, 25 bp, Rattus norvegicus
tttcaaaagcccataccaggcctgg

SEQ ID NO: 689090 - DNA, 25 bp, Rattus norvegicus
tttcaaaagcccttaccaggcctgg

SEQ ID NO: 689091 - DNA, 25 bp, Rattus norvegicus
tttcaaaaggctcccgaggtccgtc

SEQ ID NO: 689092 - DNA, 25 bp, Rattus norvegicus
tttcaaaaggctgccgaggtccgtc

SEQ ID NO: 689093 - DNA, 25 bp, Rattus norvegicus
tttcaaaatataacagctctctcta

SEQ ID NO: 689094 - DNA, 25 bp, Rattus norvegicus
tttcaaaatatatcagctctctcta

SEQ ID NO: 689095 - DNA, 25 bp, Rattus norvegicus
tttcaaacacaaacactgccagcct

SEQ ID NO: 689096 - DNA, 25 bp, Rattus norvegicus
tttcaaacacaatcactgccagcct

SEQ ID NO: 689097 - DNA, 25 bp, Rattus norvegicus
tttcaaaccacactgtatgtcccag

SEQ ID NO: 689098 - DNA, 25 bp, Rattus norvegicus
tttcaaaccacagtgtatgtcccag

SEQ ID NO: 689099 - DNA, 25 bp, Rattus norvegicus
tttcaaaccgcaacccattctctgg

SEQ ID NO: 689100 - DNA, 25 bp, Rattus norvegicus
tttcaaaccgcatcccattctctgg

SEQ ID NO: 689101 - DNA, 25 bp, Rattus norvegicus
tttcaaactggaacctggctatttt

SEQ ID NO: 689102 - DNA, 25 bp, Rattus norvegicus
tttcaaactggatcctggctatttt

SEQ ID NO: 689103 - DNA, 25 bp, Rattus norvegicus
tttcaaagcagccaacacttcacta

SEQ ID NO: 689104 - DNA, 25 bp, Rattus norvegicus
tttcaaagcagcgaacacttcacta

SEQ ID NO: 689105 - DNA, 25 bp, Rattus norvegicus
tttcaaagcttccttatccacctga

SEQ ID NO: 689106 - DNA, 25 bp, Rattus norvegicus
tttcaaagcttcgttatccacctga

SEQ ID NO: 689107 - DNA, 25 bp, Rattus norvegicus
tttcaaagtgatctcacctgtcagg

SEQ ID NO: 689108 - DNA, 25 bp, Rattus norvegicus
tttcaaagtgatgtcacctgtcagg

SEQ ID NO: 689109 - DNA, 25 bp, Rattus norvegicus
tttcaaatacccacaggcgctcagg

SEQ ID NO: 689110 - DNA, 25 bp, Rattus norvegicus
tttcaaatacccagagctgccagct

SEQ ID NO: 689111 - DNA, 25 bp, Rattus norvegicus
tttcaaataccctcaggcgctcagg

SEQ ID NO: 689112 - DNA, 25 bp, Rattus norvegicus
tttcaaataccctgagctgccagct

SEQ ID NO: 689113 - DNA, 25 bp, Rattus norvegicus
tttcaaatcaaacccacctattcct

SEQ ID NO: 689114 - DNA, 25 bp, Rattus norvegicus
tttcaaatcaaagccacctattcct

SEQ ID NO: 689115 - DNA, 25 bp, Rattus norvegicus
tttcaaatgagcaagtccccactgt

SEQ ID NO: 689116 - DNA, 25 bp, Rattus norvegicus
tttcaaatgagctagtccccactgt

SEQ ID NO: 689117 - DNA, 25 bp, Rattus norvegicus
tttcaaatgcccaagtctgtaagtt

SEQ ID NO: 689118 - DNA, 25 bp, Rattus norvegicus
tttcaaatgccctagtctgtaagtt

SEQ ID NO: 689119 - DNA, 25 bp, Rattus norvegicus
tttcaacacctgagctggaagcggg

SEQ ID NO: 689120 - DNA, 25 bp, Rattus norvegicus
tttcaacacctgtgctggaagcggg

SEQ ID NO: 689121 - DNA, 25 bp, Rattus norvegicus
tttcaacactttctgggttgcactt

SEQ ID NO: 689122 - DNA, 25 bp, Rattus norvegicus
tttcaacactttgtgggttgcactt

SEQ ID NO: 689123 - DNA, 25 bp, Rattus norvegicus
tttcaacataatacagccagggcct

SEQ ID NO: 689124 - DNA, 25 bp, Rattus norvegicus
tttcaacataattcagccagggcct

SEQ ID NO: 689125 - DNA, 25 bp, Rattus norvegicus
tttcaaccacagacccatggtgacc

SEQ ID NO: 689126 - DNA, 25 bp, Rattus norvegicus
tttcaaccacagtcccatggtgacc

SEQ ID NO: 689127 - DNA, 25 bp, Rattus norvegicus
tttcaaccaggacccctctagctgt

SEQ ID NO: 689128 - DNA, 25 bp, Rattus norvegicus
tttcaaccaggagccctctagctgt

SEQ ID NO: 689129 - DNA, 25 bp, Rattus norvegicus
tttcaaccatgcacctcaaagcggt

SEQ ID NO: 689130 - DNA, 25 bp, Rattus norvegicus
tttcaaccatgctcctcaaagcggt

SEQ ID NO: 689131 - DNA, 25 bp, Rattus norvegicus
tttcaaccctcgcaagcacaagttt

SEQ ID NO: 689132 - DNA, 25 bp, Rattus norvegicus
tttcaaccctcggaagcacaagttt

SEQ ID NO: 689133 - DNA, 25 bp, Rattus norvegicus
tttcaacctggacgctatctggcac

SEQ ID NO: 689134 - DNA, 25 bp, Rattus norvegicus
tttcaacctggaggctatctggcac

SEQ ID NO: 689135 - DNA, 25 bp, Rattus norvegicus
tttcaacggattactgtgccctgct

SEQ ID NO: 689136 - DNA, 25 bp, Rattus norvegicus
tttcaacggatttctgtgccctgct

SEQ ID NO: 689137 - DNA, 25 bp, Rattus norvegicus
tttcaactagacatgatggcccaca

SEQ ID NO: 689138 - DNA, 25 bp, Rattus norvegicus
tttcaactagacttgatggcccaca

SEQ ID NO: 689139 - DNA, 25 bp, Rattus norvegicus
tttcaactctccaagatcctttagg

SEQ ID NO: 689140 - DNA, 25 bp, Rattus norvegicus
tttcaactctcctagatcctttagg

SEQ ID NO: 689141 - DNA, 25 bp, Rattus norvegicus
tttcaactgcgcaaagaagggcttc

SEQ ID NO: 689142 - DNA, 25 bp, Rattus norvegicus
tttcaactgcgctaagaagggcttc

SEQ ID NO: 689143 - DNA, 25 bp, Rattus norvegicus
tttcaactgggaatgctagccctca

SEQ ID NO: 689144 - DNA, 25 bp, Rattus norvegicus
tttcaactgggattgctagccctca

SEQ ID NO: 689145 - DNA, 25 bp, Rattus norvegicus
tttcaactttgaactcggaggcatt

SEQ ID NO: 689146 - DNA, 25 bp, Rattus norvegicus
tttcaactttgatctcggaggcatt

SEQ ID NO: 689147 - DNA, 25 bp, Rattus norvegicus
tttcaagaaagccttgccggccctt

SEQ ID NO: 689148 - DNA, 25 bp, Rattus norvegicus
tttcaagaaagcgttgccggccctt

SEQ ID NO: 689149 - DNA, 25 bp, Rattus norvegicus
tttcaagaagtccaaatccctccat

SEQ ID NO: 689150 - DNA, 25 bp, Rattus norvegicus
tttcaagaagtcgaaatccctccat

SEQ ID NO: 689151 - DNA, 25 bp, Rattus norvegicus
tttcaagagggaaacccagcctcta

SEQ ID NO: 689152 - DNA, 25 bp, Rattus norvegicus
tttcaagagggatacccagcctcta

SEQ ID NO: 689153 - DNA, 25 bp, Rattus norvegicus
tttcaagatgcacttcttgggtggg

SEQ ID NO: 689154 - DNA, 25 bp, Rattus norvegicus
tttcaagatgcagttcttgggtggg

SEQ ID NO: 689155 - DNA, 25 bp, Rattus norvegicus
tttcaagatgccctcaattctcagt

SEQ ID NO: 689156 - DNA, 25 bp, Rattus norvegicus
tttcaagatgccgtcaattctcagt

SEQ ID NO: 689157 - DNA, 25 bp, Rattus norvegicus
tttcaagcaagcagcaggtcgccag

SEQ ID NO: 689158 - DNA, 25 bp, Rattus norvegicus
tttcaagcaagctgcaggtcgccag

SEQ ID NO: 689159 - DNA, 25 bp, Rattus norvegicus
tttcaagcagcaaagcctgtgttgc

SEQ ID NO: 689160 - DNA, 25 bp, Rattus norvegicus
tttcaagcagcatagcctgtgttgc

SEQ ID NO: 689161 - DNA, 25 bp, Rattus norvegicus
tttcaagcagccacaacattttcaa

SEQ ID NO: 689162 - DNA, 25 bp, Rattus norvegicus
tttcaagcagcctcaacattttcaa

SEQ ID NO: 689163 - DNA, 25 bp, Rattus norvegicus
tttcaagcagctcttatttcctcag

SEQ ID NO: 689164 - DNA, 25 bp, Rattus norvegicus
tttcaagcagctgttatttcctcag

SEQ ID NO: 689165 - DNA, 25 bp, Rattus norvegicus
tttcaagcattgcagtcgcaccggt

SEQ ID NO: 689166 - DNA, 25 bp, Rattus norvegicus
tttcaagcattggagtcgcaccggt

SEQ ID NO: 689167 - DNA, 25 bp, Rattus norvegicus
tttcaagcctgaagggtcagctctg

SEQ ID NO: 689168 - DNA, 25 bp, Rattus norvegicus
tttcaagcctgatgggtcagctctg

SEQ ID NO: 689169 - DNA, 25 bp, Rattus norvegicus
tttcaagccttccatactctaatca

SEQ ID NO: 689170 - DNA, 25 bp, Rattus norvegicus
tttcaagccttcgatactctaatca

SEQ ID NO: 689171 - DNA, 25 bp, Rattus norvegicus
tttcaaggaagtacgcctggtcccg

SEQ ID NO: 689172 - DNA, 25 bp, Rattus norvegicus
tttcaaggaagttcgcctggtcccg

SEQ ID NO: 689173 - DNA, 25 bp, Rattus norvegicus
tttcaaggatccagacatcctcttc

SEQ ID NO: 689174 - DNA, 25 bp, Rattus norvegicus
tttcaaggatcctgacatcctcttc

SEQ ID NO: 689175 - DNA, 25 bp, Rattus norvegicus
tttcaagggcagatgtaggcatgat

SEQ ID NO: 689176 - DNA, 25 bp, Rattus norvegicus
tttcaagggcagttgtaggcatgat

SEQ ID NO: 689177 - DNA, 25 bp, Rattus norvegicus
tttcaaggtgcgctgtcacacactt

SEQ ID NO: 689178 - DNA, 25 bp, Rattus norvegicus
tttcaaggtgcggtgtcacacactt

SEQ ID NO: 689179 - DNA, 25 bp, Rattus norvegicus
tttcaagtcattacctcctttgagg

SEQ ID NO: 689180 - DNA, 25 bp, Rattus norvegicus
tttcaagtcatttcctcctttgagg

SEQ ID NO: 689181 - DNA, 25 bp, Rattus norvegicus
tttcaagtcgtccttggacaacttt

SEQ ID NO: 689182 - DNA, 25 bp, Rattus norvegicus
tttcaagtcgtcgttggacaacttt

SEQ ID NO: 689183 - DNA, 25 bp, Rattus norvegicus
tttcaagtgttaaccaccatcctgg

SEQ ID NO: 689184 - DNA, 25 bp, Rattus norvegicus
tttcaagtgttatccaccatcctgg

SEQ ID NO: 689185 - DNA, 25 bp, Rattus norvegicus
tttcaagttactatccctcagacag

SEQ ID NO: 689186 - DNA, 25 bp, Rattus norvegicus
tttcaagttactttccctcagacag

SEQ ID NO: 689187 - DNA, 25 bp, Rattus norvegicus
tttcaagttggtcgcttagggctaa

SEQ ID NO: 689188 - DNA, 25 bp, Rattus norvegicus
tttcaagttggtggcttagggctaa

SEQ ID NO: 689189 - DNA, 25 bp, Rattus norvegicus
tttcaagttttaccggagctgcact

SEQ ID NO: 689190 - DNA, 25 bp, Rattus norvegicus
tttcaagttttagcggagctgcact

SEQ ID NO: 689191 - DNA, 25 bp, Rattus norvegicus
tttcaatactgaactgtcctctttc

SEQ ID NO: 689192 - DNA, 25 bp, Rattus norvegicus
tttcaatactgatctgtcctctttc

SEQ ID NO: 689193 - DNA, 25 bp, Rattus norvegicus
tttcaatactttaacccagctcgag

SEQ ID NO: 689194 - DNA, 25 bp, Rattus norvegicus
tttcaatacttttacccagctcgag

SEQ ID NO: 689195 - DNA, 25 bp, Rattus norvegicus
tttcaatcagtcacgtgttctgtcc

SEQ ID NO: 689196 - DNA, 25 bp, Rattus norvegicus
tttcaatcagtctcgtgttctgtcc

SEQ ID NO: 689197 - DNA, 25 bp, Rattus norvegicus
tttcaatcccagagtccacagttca

SEQ ID NO: 689198 - DNA, 25 bp, Rattus norvegicus
tttcaatcccagtgtccacagttca

SEQ ID NO: 689199 - DNA, 25 bp, Rattus norvegicus
tttcaatctctaaatttcaactttt

SEQ ID NO: 689200 - DNA, 25 bp, Rattus norvegicus
tttcaatctctatatttcaactttt

SEQ ID NO: 689201 - DNA, 25 bp, Rattus norvegicus
tttcaatctctcactacttaggcaa

SEQ ID NO: 689202 - DNA, 25 bp, Rattus norvegicus
tttcaatctctctctacttaggcaa

SEQ ID NO: 689203 - DNA, 25 bp, Rattus norvegicus
tttcaatctgcccttcactagggtc

SEQ ID NO: 689204 - DNA, 25 bp, Rattus norvegicus
tttcaatctgccgttcactagggtc

SEQ ID NO: 689205 - DNA, 25 bp, Rattus norvegicus
tttcaatgacctcagctacaagtat

SEQ ID NO: 689206 - DNA, 25 bp, Rattus norvegicus
tttcaatgacctgagctacaagtat

SEQ ID NO: 689207 - DNA, 25 bp, Rattus norvegicus
tttcaatgcttgatgctcctctagc

SEQ ID NO: 689208 - DNA, 25 bp, Rattus norvegicus
tttcaatgcttgttgctcctctagc

SEQ ID NO: 689209 - DNA, 25 bp, Rattus norvegicus
tttcaatggctcaaacacaactgtt

SEQ ID NO: 689210 - DNA, 25 bp, Rattus norvegicus
tttcaatggctctaacacaactgtt

SEQ ID NO: 689211 - DNA, 25 bp, Rattus norvegicus
tttcaatgtagtatgcgtgtgcgtt

SEQ ID NO: 689212 - DNA, 25 bp, Rattus norvegicus
tttcaatgtagtttgcgtgtgcgtt

SEQ ID NO: 689213 - DNA, 25 bp, Rattus norvegicus
tttcaatgtcccatttaaagtccag

SEQ ID NO: 689214 - DNA, 25 bp, Rattus norvegicus
tttcaatgtcccttttaaagtccag

SEQ ID NO: 689215 - DNA, 25 bp, Rattus norvegicus
tttcaattagctactgccagtaaat

SEQ ID NO: 689216 - DNA, 25 bp, Rattus norvegicus
tttcaattagcttctgccagtaaat

SEQ ID NO: 689217 - DNA, 25 bp, Rattus norvegicus
tttcaattccttaccgcagacgaga

SEQ ID NO: 689218 - DNA, 25 bp, Rattus norvegicus
tttcaattcctttccgcagacgaga

SEQ ID NO: 689219 - DNA, 25 bp, Rattus norvegicus
tttcaatttcacagttgggcccagt

SEQ ID NO: 689220 - DNA, 25 bp, Rattus norvegicus
tttcaatttcactgttgggcccagt

SEQ ID NO: 689221 - DNA, 25 bp, Rattus norvegicus
tttcaattttacaagacagtgtcat

SEQ ID NO: 689222 - DNA, 25 bp, Rattus norvegicus
tttcaattttactagacagtgtcat

SEQ ID NO: 689223 - DNA, 25 bp, Rattus norvegicus
tttcacaaatggcagacttgaagat

SEQ ID NO: 689224 - DNA, 25 bp, Rattus norvegicus
tttcacaaatgggagacttgaagat

SEQ ID NO: 689225 - DNA, 25 bp, Rattus norvegicus
tttcacaacattctttggctcccaa

SEQ ID NO: 689226 - DNA, 25 bp, Rattus norvegicus
tttcacaacattgtttggctcccaa

SEQ ID NO: 689227 - DNA, 25 bp, Rattus norvegicus
tttcacacacttcttctacagtgta

SEQ ID NO: 689228 - DNA, 25 bp, Rattus norvegicus
tttcacacacttgttctacagtgta

SEQ ID NO: 689229 - DNA, 25 bp, Rattus norvegicus
tttcacacatttccttgtttctcag

SEQ ID NO: 689230 - DNA, 25 bp, Rattus norvegicus
tttcacacatttgcttgtttctcag

SEQ ID NO: 689231 - DNA, 25 bp, Rattus norvegicus
tttcacaccacgatccaagcagcag

SEQ ID NO: 689232 - DNA, 25 bp, Rattus norvegicus
tttcacaccacgttccaagcagcag

SEQ ID NO: 689233 - DNA, 25 bp, Rattus norvegicus
tttcacacctacctttcttgtcttt

SEQ ID NO: 689234 - DNA, 25 bp, Rattus norvegicus
tttcacacctacgtttcttgtcttt

SEQ ID NO: 689235 - DNA, 25 bp, Rattus norvegicus
tttcacacctagattcctatgccaa

SEQ ID NO: 689236 - DNA, 25 bp, Rattus norvegicus
tttcacacctagtttcctatgccaa

SEQ ID NO: 689237 - DNA, 25 bp, Rattus norvegicus
tttcacacctgcactgtgcttcagt

SEQ ID NO: 689238 - DNA, 25 bp, Rattus norvegicus
tttcacacctgctctgtgcttcagt

SEQ ID NO: 689239 - DNA, 25 bp, Rattus norvegicus
tttcacaccttgattggcattgctg

SEQ ID NO: 689240 - DNA, 25 bp, Rattus norvegicus
tttcacaccttgtttggcattgctg

SEQ ID NO: 689241 - DNA, 25 bp, Rattus norvegicus
tttcacacttgaaagcagctgccat

SEQ ID NO: 689242 - DNA, 25 bp, Rattus norvegicus
tttcacacttgatagcagctgccat

SEQ ID NO: 689243 - DNA, 25 bp, Rattus norvegicus
tttcacagcaggactttgactccca

SEQ ID NO: 689244 - DNA, 25 bp, Rattus norvegicus
tttcacagcaggtctttgactccca

SEQ ID NO: 689245 - DNA, 25 bp, Rattus norvegicus
tttcacagccaaagactctggtcat

SEQ ID NO: 689246 - DNA, 25 bp, Rattus norvegicus
tttcacagccaatgactctggtcat

SEQ ID NO: 689247 - DNA, 25 bp, Rattus norvegicus
tttcacagccctctggagcagtcat

SEQ ID NO: 689248 - DNA, 25 bp, Rattus norvegicus
tttcacagccctgtggagcagtcat

SEQ ID NO: 689249 - DNA, 25 bp, Rattus norvegicus
tttcacagccgcacagctcatgaag

SEQ ID NO: 689250 - DNA, 25 bp, Rattus norvegicus
tttcacagccgctcagctcatgaag

SEQ ID NO: 689251 - DNA, 25 bp, Rattus norvegicus
tttcacagcctcaaacccttaggga

SEQ ID NO: 689252 - DNA, 25 bp, Rattus norvegicus
tttcacagcctctaacccttaggga

SEQ ID NO: 689253 - DNA, 25 bp, Rattus norvegicus
tttcacagcgcgagaacaccagttt

SEQ ID NO: 689254 - DNA, 25 bp, Rattus norvegicus
tttcacagcgcgtgaacaccagttt

SEQ ID NO: 689255 - DNA, 25 bp, Rattus norvegicus
tttcacagcgctcctaccaatgact

SEQ ID NO: 689256 - DNA, 25 bp, Rattus norvegicus
tttcacagcgctgctaccaatgact

SEQ ID NO: 689257 - DNA, 25 bp, Rattus norvegicus
tttcacagcgttattggaaagcata

SEQ ID NO: 689258 - DNA, 25 bp, Rattus norvegicus
tttcacagcgtttttggaaagcata

SEQ ID NO: 689259 - DNA, 25 bp, Rattus norvegicus
tttcacagcttacacactcacggag

SEQ ID NO: 689260 - DNA, 25 bp, Rattus norvegicus
tttcacagcttagacactcacggag

SEQ ID NO: 689261 - DNA, 25 bp, Rattus norvegicus
tttcacaggactcatctttccatcc

SEQ ID NO: 689262 - DNA, 25 bp, Rattus norvegicus
tttcacaggactgatctttccatcc

SEQ ID NO: 689263 - DNA, 25 bp, Rattus norvegicus
tttcacaggcgaacccggaggaggt

SEQ ID NO: 689264 - DNA, 25 bp, Rattus norvegicus
tttcacaggcgatcccggaggaggt

SEQ ID NO: 689265 - DNA, 25 bp, Rattus norvegicus
tttcacagggatctgctctgtctgt

SEQ ID NO: 689266 - DNA, 25 bp, Rattus norvegicus
tttcacagggatgtgctctgtctgt

SEQ ID NO: 689267 - DNA, 25 bp, Rattus norvegicus
tttcacagtgctcagcaggcaccct

SEQ ID NO: 689268 - DNA, 25 bp, Rattus norvegicus
tttcacagtgctgagcaggcaccct

SEQ ID NO: 689269 - DNA, 25 bp, Rattus norvegicus
tttcacagtggaccgctggctggcc

SEQ ID NO: 689270 - DNA, 25 bp, Rattus norvegicus
tttcacagtggagcgctggctggcc

SEQ ID NO: 689271 - DNA, 25 bp, Rattus norvegicus
tttcacagttagctggactaggcga

SEQ ID NO: 689272 - DNA, 25 bp, Rattus norvegicus
tttcacagttaggtggactaggcga

SEQ ID NO: 689273 - DNA, 25 bp, Rattus norvegicus
tttcacagttccatcaaatgcacca

SEQ ID NO: 689274 - DNA, 25 bp, Rattus norvegicus
tttcacagttccttcaaatgcacca

SEQ ID NO: 689275 - DNA, 25 bp, Rattus norvegicus
tttcacatgtctcccaagaagactt

SEQ ID NO: 689276 - DNA, 25 bp, Rattus norvegicus
tttcacatgtctgccaagaagactt

SEQ ID NO: 689277 - DNA, 25 bp, Rattus norvegicus
tttcacattgtaaagctgccactgt

SEQ ID NO: 689278 - DNA, 25 bp, Rattus norvegicus
tttcacattgtatagctgccactgt

SEQ ID NO: 689279 - DNA, 25 bp, Rattus norvegicus
tttcaccaaacaaccagcttttttc

SEQ ID NO: 689280 - DNA, 25 bp, Rattus norvegicus
tttcaccaaacatccagcttttttc

SEQ ID NO: 689281 - DNA, 25 bp, Rattus norvegicus
tttcaccaaagcatgccaagcccaa

SEQ ID NO: 689282 - DNA, 25 bp, Rattus norvegicus
tttcaccaaagcttgccaagcccaa

SEQ ID NO: 689283 - DNA, 25 bp, Rattus norvegicus
tttcaccaagatctccagctggagt

SEQ ID NO: 689284 - DNA, 25 bp, Rattus norvegicus
tttcaccaagatgtccagctggagt

SEQ ID NO: 689285 - DNA, 25 bp, Rattus norvegicus
tttcaccagccccataaatgtctat

SEQ ID NO: 689286 - DNA, 25 bp, Rattus norvegicus
tttcaccagcccgataaatgtctat

SEQ ID NO: 689287 - DNA, 25 bp, Rattus norvegicus
tttcaccagggaacttggagccaga

SEQ ID NO: 689288 - DNA, 25 bp, Rattus norvegicus
tttcaccagggatcttggagccaga

SEQ ID NO: 689289 - DNA, 25 bp, Rattus norvegicus
tttcaccagggtctgcaggaggctc

SEQ ID NO: 689290 - DNA, 25 bp, Rattus norvegicus
tttcaccagggtgtgcaggaggctc

SEQ ID NO: 689291 - DNA, 25 bp, Rattus norvegicus
tttcaccatcctcaagctctgcagt

SEQ ID NO: 689292 - DNA, 25 bp, Rattus norvegicus
tttcaccatcctgaagctctgcagt

SEQ ID NO: 689293 - DNA, 25 bp, Rattus norvegicus
tttcaccatctcaactgacacaaag

SEQ ID NO: 689294 - DNA, 25 bp, Rattus norvegicus
tttcaccatctctactgacacaaag

SEQ ID NO: 689295 - DNA, 25 bp, Rattus norvegicus
tttcacccagccatattgttttaat

SEQ ID NO: 689296 - DNA, 25 bp, Rattus norvegicus
tttcacccagccttattgttttaat

SEQ ID NO: 689297 - DNA, 25 bp, Rattus norvegicus
tttcacccagtcagatccaggccgg

SEQ ID NO: 689298 - DNA, 25 bp, Rattus norvegicus
tttcacccagtctgatccaggccgg

SEQ ID NO: 689299 - DNA, 25 bp, Rattus norvegicus
tttcaccccagccaagcggatatgt

SEQ ID NO: 689300 - DNA, 25 bp, Rattus norvegicus
tttcaccccagcgaagcggatatgt

SEQ ID NO: 689301 - DNA, 25 bp, Rattus norvegicus
tttcaccccttgagatcctgagaag

SEQ ID NO: 689302 - DNA, 25 bp, Rattus norvegicus
tttcaccccttgtgatcctgagaag

SEQ ID NO: 689303 - DNA, 25 bp, Rattus norvegicus
tttcacccttgaatatccgcagatg

SEQ ID NO: 689304 - DNA, 25 bp, Rattus norvegicus
tttcacccttgattatccgcagatg

SEQ ID NO: 689305 - DNA, 25 bp, Rattus norvegicus
tttcaccctttcagatgcccagata

SEQ ID NO: 689306 - DNA, 25 bp, Rattus norvegicus
tttcaccctttctgatgcccagata

SEQ ID NO: 689307 - DNA, 25 bp, Rattus norvegicus
tttcaccgccatctcttaagtaagg

SEQ ID NO: 689308 - DNA, 25 bp, Rattus norvegicus
tttcaccgccatgtcttaagtaagg

SEQ ID NO: 689309 - DNA, 25 bp, Rattus norvegicus
tttcacctcatcagtgtttttgcac

SEQ ID NO: 689310 - DNA, 25 bp, Rattus norvegicus
tttcacctcatctgtgtttttgcac

SEQ ID NO: 689311 - DNA, 25 bp, Rattus norvegicus
tttcacctctggcagcctggaccag

SEQ ID NO: 689312 - DNA, 25 bp, Rattus norvegicus
tttcacctctgggagcctggaccag

SEQ ID NO: 689313 - DNA, 25 bp, Rattus norvegicus
tttcacctcttgacctggaacttgt

SEQ ID NO: 689314 - DNA, 25 bp, Rattus norvegicus
tttcacctcttgtcctggaacttgt

SEQ ID NO: 689315 - DNA, 25 bp, Rattus norvegicus
tttcacctgatgcaacactctggat

SEQ ID NO: 689316 - DNA, 25 bp, Rattus norvegicus
tttcacctgatggaacactctggat

SEQ ID NO: 689317 - DNA, 25 bp, Rattus norvegicus
tttcacctgccaatcagctgttaat

SEQ ID NO: 689318 - DNA, 25 bp, Rattus norvegicus
tttcacctgccattcagctgttaat

SEQ ID NO: 689319 - DNA, 25 bp, Rattus norvegicus
tttcacctgccccatgttatgcaac

SEQ ID NO: 689320 - DNA, 25 bp, Rattus norvegicus
tttcacctgcccgatgttatgcaac

SEQ ID NO: 689321 - DNA, 25 bp, Rattus norvegicus
tttcacctggaacacagaggccctc

SEQ ID NO: 689322 - DNA, 25 bp, Rattus norvegicus
tttcacctggaagacagaggccctc

SEQ ID NO: 689323 - DNA, 25 bp, Rattus norvegicus
tttcacctggatctttgtccgtgtt

SEQ ID NO: 689324 - DNA, 25 bp, Rattus norvegicus
tttcacctggatgtttgtccgtgtt

SEQ ID NO: 689325 - DNA, 25 bp, Rattus norvegicus
tttcacctggcaatgtactgtatca

SEQ ID NO: 689326 - DNA, 25 bp, Rattus norvegicus
tttcacctggcattgtactgtatca

SEQ ID NO: 689327 - DNA, 25 bp, Rattus norvegicus
tttcacctggctcgcccgggcagga

SEQ ID NO: 689328 - DNA, 25 bp, Rattus norvegicus
tttcacctggctggcccgggcagga

SEQ ID NO: 689329 - DNA, 25 bp, Rattus norvegicus
tttcacctggtcctctgaattgaag

SEQ ID NO: 689330 - DNA, 25 bp, Rattus norvegicus
tttcacctggtcgtctgaattgaag

SEQ ID NO: 689331 - DNA, 25 bp, Rattus norvegicus
tttcacctgtgcctctattattatg

SEQ ID NO: 689332 - DNA, 25 bp, Rattus norvegicus
tttcacctgtgcgtctattattatg

SEQ ID NO: 689333 - DNA, 25 bp, Rattus norvegicus
tttcacctgttgcttttcactcaat

SEQ ID NO: 689334 - DNA, 25 bp, Rattus norvegicus
tttcacctgttggttttcactcaat

SEQ ID NO: 689335 - DNA, 25 bp, Rattus norvegicus
tttcaccttgctcggcagtagttca

SEQ ID NO: 689336 - DNA, 25 bp, Rattus norvegicus
tttcaccttgctgggcagtagttca

SEQ ID NO: 689337 - DNA, 25 bp, Rattus norvegicus
tttcaccttggaagctgacttctaa

SEQ ID NO: 689338 - DNA, 25 bp, Rattus norvegicus
tttcaccttggatgctgacttctaa

SEQ ID NO: 689339 - DNA, 25 bp, Rattus norvegicus
tttcaccttgtcacttcatgtcgtc

SEQ ID NO: 689340 - DNA, 25 bp, Rattus norvegicus
tttcaccttgtctcttcatgtcgtc

SEQ ID NO: 689341 - DNA, 25 bp, Rattus norvegicus
tttcacgaagttactctccggagat

SEQ ID NO: 689342 - DNA, 25 bp, Rattus norvegicus
tttcacgaagtttctctccggagat

SEQ ID NO: 689343 - DNA, 25 bp, Rattus norvegicus
tttcacgagctccagagcactctgg

SEQ ID NO: 689344 - DNA, 25 bp, Rattus norvegicus
tttcacgagctcgagagcactctgg

SEQ ID NO: 689345 - DNA, 25 bp, Rattus norvegicus
tttcacgcagtgactccattcattg

SEQ ID NO: 689346 - DNA, 25 bp, Rattus norvegicus
tttcacgcagtgtctccattcattg

SEQ ID NO: 689347 - DNA, 25 bp, Rattus norvegicus
tttcacgcccagaaaaccagctgat

SEQ ID NO: 689348 - DNA, 25 bp, Rattus norvegicus
tttcacgcccagtaaaccagctgat

SEQ ID NO: 689349 - DNA, 25 bp, Rattus norvegicus
tttcacgctggcattgtttcagaga

SEQ ID NO: 689350 - DNA, 25 bp, Rattus norvegicus
tttcacgctggctttgtttcagaga

SEQ ID NO: 689351 - DNA, 25 bp, Rattus norvegicus
tttcacggaattcttcagtccagag

SEQ ID NO: 689352 - DNA, 25 bp, Rattus norvegicus
tttcacggaattgttcagtccagag

SEQ ID NO: 689353 - DNA, 25 bp, Rattus norvegicus
tttcacggactcacagcttgagtgt

SEQ ID NO: 689354 - DNA, 25 bp, Rattus norvegicus
tttcacggactctcagcttgagtgt

SEQ ID NO: 689355 - DNA, 25 bp, Rattus norvegicus
tttcacggagatatttatagccacg

SEQ ID NO: 689356 - DNA, 25 bp, Rattus norvegicus
tttcacggagatttttatagccacg

SEQ ID NO: 689357 - DNA, 25 bp, Rattus norvegicus
tttcacggcactaagacctgacggg

SEQ ID NO: 689358 - DNA, 25 bp, Rattus norvegicus
tttcacggcacttagacctgacggg

SEQ ID NO: 689359 - DNA, 25 bp, Rattus norvegicus
tttcacggcagtcgtacttgtctct

SEQ ID NO: 689360 - DNA, 25 bp, Rattus norvegicus
tttcacggcagtggtacttgtctct

SEQ ID NO: 689361 - DNA, 25 bp, Rattus norvegicus
tttcacgggccaagcacaggtgtgc

SEQ ID NO: 689362 - DNA, 25 bp, Rattus norvegicus
tttcacgggccatgcacaggtgtgc

SEQ ID NO: 689363 - DNA, 25 bp, Rattus norvegicus
tttcacgggctgattacaacctaag

SEQ ID NO: 689364 - DNA, 25 bp, Rattus norvegicus
tttcacgggctgtttacaacctaag

SEQ ID NO: 689365 - DNA, 25 bp, Rattus norvegicus
tttcacgtcaccagttctcaagaag

SEQ ID NO: 689366 - DNA, 25 bp, Rattus norvegicus
tttcacgtcacctgttctcaagaag

SEQ ID NO: 689367 - DNA, 25 bp, Rattus norvegicus
tttcacgtccttcatgttgcagtat

SEQ ID NO: 689368 - DNA, 25 bp, Rattus norvegicus
tttcacgtccttgatgttgcagtat

SEQ ID NO: 689369 - DNA, 25 bp, Rattus norvegicus
tttcacgtgcctcggaaaccggagt

SEQ ID NO: 689370 - DNA, 25 bp, Rattus norvegicus
tttcacgtgcctgggaaaccggagt

SEQ ID NO: 689371 - DNA, 25 bp, Rattus norvegicus
tttcactaaacgatgatggcttata

SEQ ID NO: 689372 - DNA, 25 bp, Rattus norvegicus
tttcactaaacgttgatggcttata

SEQ ID NO: 689373 - DNA, 25 bp, Rattus norvegicus
tttcactaactgatcgtcctggcaa

SEQ ID NO: 689374 - DNA, 25 bp, Rattus norvegicus
tttcactaactgttcgtcctggcaa

SEQ ID NO: 689375 - DNA, 25 bp, Rattus norvegicus
tttcactagagtcacttggcctctc

SEQ ID NO: 689376 - DNA, 25 bp, Rattus norvegicus
tttcactagagtgacttggcctctc

SEQ ID NO: 689377 - DNA, 25 bp, Rattus norvegicus
tttcactctgtgaggcttacattgg

SEQ ID NO: 689378 - DNA, 25 bp, Rattus norvegicus
tttcactctgtgtggcttacattgg

SEQ ID NO: 689379 - DNA, 25 bp, Rattus norvegicus
tttcactgactcagacattctcctt

SEQ ID NO: 689380 - DNA, 25 bp, Rattus norvegicus
tttcactgactctgacattctcctt

SEQ ID NO: 689381 - DNA, 25 bp, Rattus norvegicus
tttcactgatccacgtcccagggac

SEQ ID NO: 689382 - DNA, 25 bp, Rattus norvegicus
tttcactgatcctcgtcccagggac

SEQ ID NO: 689383 - DNA, 25 bp, Rattus norvegicus
tttcactgccgtacctgggaaagaa

SEQ ID NO: 689384 - DNA, 25 bp, Rattus norvegicus
tttcactgccgttcctgggaaagaa

SEQ ID NO: 689385 - DNA, 25 bp, Rattus norvegicus
tttcactgctatactactgtctcca

SEQ ID NO: 689386 - DNA, 25 bp, Rattus norvegicus
tttcactgctattctactgtctcca

SEQ ID NO: 689387 - DNA, 25 bp, Rattus norvegicus
tttcactgctctcaacccatattga

SEQ ID NO: 689388 - DNA, 25 bp, Rattus norvegicus
tttcactgctctgaacccatattga

SEQ ID NO: 689389 - DNA, 25 bp, Rattus norvegicus
tttcactggcatcggccggccaagg

SEQ ID NO: 689390 - DNA, 25 bp, Rattus norvegicus
tttcactggcatgggccggccaagg

SEQ ID NO: 689391 - DNA, 25 bp, Rattus norvegicus
tttcactgtctaaaagcacttgtat

SEQ ID NO: 689392 - DNA, 25 bp, Rattus norvegicus
tttcactgtctataagcacttgtat

SEQ ID NO: 689393 - DNA, 25 bp, Rattus norvegicus
tttcactgtgtgctcttagctatca

SEQ ID NO: 689394 - DNA, 25 bp, Rattus norvegicus
tttcactgtgtggtcttagctatca

SEQ ID NO: 689395 - DNA, 25 bp, Rattus norvegicus
tttcacttccacaagaactggaggt

SEQ ID NO: 689396 - DNA, 25 bp, Rattus norvegicus
tttcacttccacacacagaactaag

SEQ ID NO: 689397 - DNA, 25 bp, Rattus norvegicus
tttcacttccactagaactggaggt

SEQ ID NO: 689398 - DNA, 25 bp, Rattus norvegicus
tttcacttccactcacagaactaag

SEQ ID NO: 689399 - DNA, 25 bp, Rattus norvegicus
tttcacttctgacggtgctggtgtt

SEQ ID NO: 689400 - DNA, 25 bp, Rattus norvegicus
tttcacttctgagggtgctggtgtt

SEQ ID NO: 689401 - DNA, 25 bp, Rattus norvegicus
tttcactttccaacgacagtacttg

SEQ ID NO: 689402 - DNA, 25 bp, Rattus norvegicus
tttcactttccatcgacagtacttg

SEQ ID NO: 689403 - DNA, 25 bp, Rattus norvegicus
tttcacttttgaaatataaacaggt

SEQ ID NO: 689404 - DNA, 25 bp, Rattus norvegicus
tttcacttttgatatataaacaggt

SEQ ID NO: 689405 - DNA, 25 bp, Rattus norvegicus
tttcagaaagcccacaatacaccca

SEQ ID NO: 689406 - DNA, 25 bp, Rattus norvegicus
tttcagaaagccgacaatacaccca

SEQ ID NO: 689407 - DNA, 25 bp, Rattus norvegicus
tttcagaacagtcctgtgcagcccc

SEQ ID NO: 689408 - DNA, 25 bp, Rattus norvegicus
tttcagaacagtgctgtgcagcccc

SEQ ID NO: 689409 - DNA, 25 bp, Rattus norvegicus
tttcagaagagccacattgtcatcg

SEQ ID NO: 689410 - DNA, 25 bp, Rattus norvegicus
tttcagaagagcgacattgtcatcg

SEQ ID NO: 689411 - DNA, 25 bp, Rattus norvegicus
tttcagaagagtagagtgacccctt

SEQ ID NO: 689412 - DNA, 25 bp, Rattus norvegicus
tttcagaagagttgagtgacccctt

SEQ ID NO: 689413 - DNA, 25 bp, Rattus norvegicus
tttcagaaggaacagatgctagcac

SEQ ID NO: 689414 - DNA, 25 bp, Rattus norvegicus
tttcagaaggaagagatgctagcac

SEQ ID NO: 689415 - DNA, 25 bp, Rattus norvegicus
tttcagaagggtcaagcccgtaact

SEQ ID NO: 689416 - DNA, 25 bp, Rattus norvegicus
tttcagaagggtgaagcccgtaact

SEQ ID NO: 689417 - DNA, 25 bp, Rattus norvegicus
tttcagaagtccacgtgataggcgc

SEQ ID NO: 689418 - DNA, 25 bp, Rattus norvegicus
tttcagaagtcctcgtgataggcgc

SEQ ID NO: 689419 - DNA, 25 bp, Rattus norvegicus
tttcagaatgctcgcaatgccggca

SEQ ID NO: 689420 - DNA, 25 bp, Rattus norvegicus
tttcagaatgctggcaatgccggca

SEQ ID NO: 689421 - DNA, 25 bp, Rattus norvegicus
tttcagaatttacctaccatacctt

SEQ ID NO: 689422 - DNA, 25 bp, Rattus norvegicus
tttcagaatttagctaccatacctt

SEQ ID NO: 689423 - DNA, 25 bp, Rattus norvegicus
tttcagacactgagcctctaaccgg

SEQ ID NO: 689424 - DNA, 25 bp, Rattus norvegicus
tttcagacactgtgcctctaaccgg

SEQ ID NO: 689425 - DNA, 25 bp, Rattus norvegicus
tttcagacagtaattccttccttcc

SEQ ID NO: 689426 - DNA, 25 bp, Rattus norvegicus
tttcagacagtatttccttccttcc

SEQ ID NO: 689427 - DNA, 25 bp, Rattus norvegicus
tttcagacagttaagtgcagagcct

SEQ ID NO: 689428 - DNA, 25 bp, Rattus norvegicus
tttcagacagtttagtgcagagcct

SEQ ID NO: 689429 - DNA, 25 bp, Rattus norvegicus
tttcagaccttacctttctttcacc

SEQ ID NO: 689430 - DNA, 25 bp, Rattus norvegicus
tttcagaccttagctttctttcacc

SEQ ID NO: 689431 - DNA, 25 bp, Rattus norvegicus
tttcagaccttcaagccggtataga

SEQ ID NO: 689432 - DNA, 25 bp, Rattus norvegicus
tttcagaccttctagccggtataga

SEQ ID NO: 689433 - DNA, 25 bp, Rattus norvegicus
tttcagactaccagtactgtcccac

SEQ ID NO: 689434 - DNA, 25 bp, Rattus norvegicus
tttcagactacctgtactgtcccac

SEQ ID NO: 689435 - DNA, 25 bp, Rattus norvegicus
tttcagactcttcttattccaggga

SEQ ID NO: 689436 - DNA, 25 bp, Rattus norvegicus
tttcagactcttgttattccaggga

SEQ ID NO: 689437 - DNA, 25 bp, Rattus norvegicus
tttcagactgccctctagtgcgctg

SEQ ID NO: 689438 - DNA, 25 bp, Rattus norvegicus
tttcagactgccgtctagtgcgctg

SEQ ID NO: 689439 - DNA, 25 bp, Rattus norvegicus
tttcagacttataaaatgcgagctt

SEQ ID NO: 689440 - DNA, 25 bp, Rattus norvegicus
tttcagacttattaaatgcgagctt

SEQ ID NO: 689441 - DNA, 25 bp, Rattus norvegicus
tttcagagcactcctatggtccgtc

SEQ ID NO: 689442 - DNA, 25 bp, Rattus norvegicus
tttcagagcactgctatggtccgtc

SEQ ID NO: 689443 - DNA, 25 bp, Rattus norvegicus
tttcagagcaggattgcagtttcct

SEQ ID NO: 689444 - DNA, 25 bp, Rattus norvegicus
tttcagagcaggtttgcagtttcct

SEQ ID NO: 689445 - DNA, 25 bp, Rattus norvegicus
tttcagagcccgactctgaggagga

SEQ ID NO: 689446 - DNA, 25 bp, Rattus norvegicus
tttcagagcccgtctctgaggagga

SEQ ID NO: 689447 - DNA, 25 bp, Rattus norvegicus
tttcagagctgaagagccgagggtt

SEQ ID NO: 689448 - DNA, 25 bp, Rattus norvegicus
tttcagagctgatgagccgagggtt

SEQ ID NO: 689449 - DNA, 25 bp, Rattus norvegicus
tttcagaggaaacgcctggaaccca

SEQ ID NO: 689450 - DNA, 25 bp, Rattus norvegicus
tttcagaggaaaggcctggaaccca

SEQ ID NO: 689451 - DNA, 25 bp, Rattus norvegicus
tttcagaggagccaacacctgcttg

SEQ ID NO: 689452 - DNA, 25 bp, Rattus norvegicus
tttcagaggagcgaacacctgcttg

SEQ ID NO: 689453 - DNA, 25 bp, Rattus norvegicus
tttcagaggataagccgggccacca

SEQ ID NO: 689454 - DNA, 25 bp, Rattus norvegicus
tttcagaggatatgccgggccacca

SEQ ID NO: 689455 - DNA, 25 bp, Rattus norvegicus
tttcagagtggcctggaccctacac

SEQ ID NO: 689456 - DNA, 25 bp, Rattus norvegicus
tttcagagtggcgtggaccctacac

SEQ ID NO: 689457 - DNA, 25 bp, Rattus norvegicus
tttcagatcacccaggccctgggca

SEQ ID NO: 689458 - DNA, 25 bp, Rattus norvegicus
tttcagatcaccgaggccctgggca

SEQ ID NO: 689459 - DNA, 25 bp, Rattus norvegicus
tttcagatgtttcctgccttgagcc

SEQ ID NO: 689460 - DNA, 25 bp, Rattus norvegicus
tttcagatgtttgctgccttgagcc

SEQ ID NO: 689461 - DNA, 25 bp, Rattus norvegicus
tttcagattcaccaagtcccttgta

SEQ ID NO: 689462 - DNA, 25 bp, Rattus norvegicus
tttcagattcacgaagtcccttgta

SEQ ID NO: 689463 - DNA, 25 bp, Rattus norvegicus
tttcagcaaagtacacagcagtcct

SEQ ID NO: 689464 - DNA, 25 bp, Rattus norvegicus
tttcagcaaagttcacagcagtcct

SEQ ID NO: 689465 - DNA, 25 bp, Rattus norvegicus
tttcagcaccgaatgctggccagtg

SEQ ID NO: 689466 - DNA, 25 bp, Rattus norvegicus
tttcagcaccgattgctggccagtg

SEQ ID NO: 689467 - DNA, 25 bp, Rattus norvegicus
tttcagcactggcaaaggcagcaga

SEQ ID NO: 689468 - DNA, 25 bp, Rattus norvegicus
tttcagcactgggaaaggcagcaga

SEQ ID NO: 689469 - DNA, 25 bp, Rattus norvegicus
tttcagcagcctcgtcttaaataca

SEQ ID NO: 689470 - DNA, 25 bp, Rattus norvegicus
tttcagcagcctggtcttaaataca

SEQ ID NO: 689471 - DNA, 25 bp, Rattus norvegicus
tttcagcagttgccaacctgtcctc

SEQ ID NO: 689472 - DNA, 25 bp, Rattus norvegicus
tttcagcagttggcaacctgtcctc

SEQ ID NO: 689473 - DNA, 25 bp, Rattus norvegicus
tttcagcatcacaagggcattctct

SEQ ID NO: 689474 - DNA, 25 bp, Rattus norvegicus
tttcagcatcactagggcattctct

SEQ ID NO: 689475 - DNA, 25 bp, Rattus norvegicus
tttcagccaactctcttcagtttac

SEQ ID NO: 689476 - DNA, 25 bp, Rattus norvegicus
tttcagccaactgtcttcagtttac

SEQ ID NO: 689477 - DNA, 25 bp, Rattus norvegicus
tttcagccatatcccactggtcaca

SEQ ID NO: 689478 - DNA, 25 bp, Rattus norvegicus
tttcagccatatgccactggtcaca

SEQ ID NO: 689479 - DNA, 25 bp, Rattus norvegicus
tttcagccatgactttacttacctc

SEQ ID NO: 689480 - DNA, 25 bp, Rattus norvegicus
tttcagccatgagtttacttacctc

SEQ ID NO: 689481 - DNA, 25 bp, Rattus norvegicus
tttcagccgcatcgctctgaagaaa

SEQ ID NO: 689482 - DNA, 25 bp, Rattus norvegicus
tttcagccgcatggctctgaagaaa

SEQ ID NO: 689483 - DNA, 25 bp, Rattus norvegicus
tttcagcctcccagtttcagtttac

SEQ ID NO: 689484 - DNA, 25 bp, Rattus norvegicus
tttcagcctccctgtttcagtttac

SEQ ID NO: 689485 - DNA, 25 bp, Rattus norvegicus
tttcagcctgagcaaaacaccggat

SEQ ID NO: 689486 - DNA, 25 bp, Rattus norvegicus
tttcagcctgaggaaaacaccggat

SEQ ID NO: 689487 - DNA, 25 bp, Rattus norvegicus
tttcagcctgggaagcgatcagcaa

SEQ ID NO: 689488 - DNA, 25 bp, Rattus norvegicus
tttcagcctgggtagcgatcagcaa

SEQ ID NO: 689489 - DNA, 25 bp, Rattus norvegicus
tttcagctcccacttattctcagaa

SEQ ID NO: 689490 - DNA, 25 bp, Rattus norvegicus
tttcagctcccagttattctcagaa

SEQ ID NO: 689491 - DNA, 25 bp, Rattus norvegicus
tttcagctcctaacttctattctgg

SEQ ID NO: 689492 - DNA, 25 bp, Rattus norvegicus
tttcagctcctatcttctattctgg

SEQ ID NO: 689493 - DNA, 25 bp, Rattus norvegicus
tttcagctcgtaatagcgttcagat

SEQ ID NO: 689494 - DNA, 25 bp, Rattus norvegicus
tttcagctcgtattagcgttcagat

SEQ ID NO: 689495 - DNA, 25 bp, Rattus norvegicus
tttcagctcttacctgcctggaggt

SEQ ID NO: 689496 - DNA, 25 bp, Rattus norvegicus
tttcagctcttagctgcctggaggt

SEQ ID NO: 689497 - DNA, 25 bp, Rattus norvegicus
tttcagctgcaactcggtagggcga

SEQ ID NO: 689498 - DNA, 25 bp, Rattus norvegicus
tttcagctgcaagtcggtagggcga

SEQ ID NO: 689499 - DNA, 25 bp, Rattus norvegicus
tttcagcttgtgcttctgaatcgct

SEQ ID NO: 689500 - DNA, 25 bp, Rattus norvegicus
tttcagcttgtggttctgaatcgct

SEQ ID NO: 689501 - DNA, 25 bp, Rattus norvegicus
tttcaggaactgacacagacctcag

SEQ ID NO: 689502 - DNA, 25 bp, Rattus norvegicus
tttcaggaactgtcacagacctcag

SEQ ID NO: 689503 - DNA, 25 bp, Rattus norvegicus
tttcaggaccctagaagagagcttt

SEQ ID NO: 689504 - DNA, 25 bp, Rattus norvegicus
tttcaggacccttgaagagagcttt

SEQ ID NO: 689505 - DNA, 25 bp, Rattus norvegicus
tttcaggagctcatctaggtcagtt

SEQ ID NO: 689506 - DNA, 25 bp, Rattus norvegicus
tttcaggagctcttctaggtcagtt

SEQ ID NO: 689507 - DNA, 25 bp, Rattus norvegicus
tttcaggatgcccatagagcttgga

SEQ ID NO: 689508 - DNA, 25 bp, Rattus norvegicus
tttcaggatgccgatagagcttgga

SEQ ID NO: 689509 - DNA, 25 bp, Rattus norvegicus
tttcaggcaccaccggctcaaaatt

SEQ ID NO: 689510 - DNA, 25 bp, Rattus norvegicus
tttcaggcaccagcggctcaaaatt

SEQ ID NO: 689511 - DNA, 25 bp, Rattus norvegicus
tttcaggcccatatggtggctgata

SEQ ID NO: 689512 - DNA, 25 bp, Rattus norvegicus
tttcaggcccatttggtggctgata

SEQ ID NO: 689513 - DNA, 25 bp, Rattus norvegicus
tttcaggccgaacatcgtggtgtca

SEQ ID NO: 689514 - DNA, 25 bp, Rattus norvegicus
tttcaggccgaagatcgtggtgtca

SEQ ID NO: 689515 - DNA, 25 bp, Rattus norvegicus
tttcaggcgaggcagctcccaggtt

SEQ ID NO: 689516 - DNA, 25 bp, Rattus norvegicus
tttcaggcgagggagctcccaggtt

SEQ ID NO: 689517 - DNA, 25 bp, Rattus norvegicus
tttcaggctggacctggcacgtcga

SEQ ID NO: 689518 - DNA, 25 bp, Rattus norvegicus
tttcaggctggagctggcacgtcga

SEQ ID NO: 689519 - DNA, 25 bp, Rattus norvegicus
tttcaggctgttctcatgtcaaggc

SEQ ID NO: 689520 - DNA, 25 bp, Rattus norvegicus
tttcaggctgttgtcatgtcaaggc

SEQ ID NO: 689521 - DNA, 25 bp, Rattus norvegicus
tttcagggccctatgacaattaaag

SEQ ID NO: 689522 - DNA, 25 bp, Rattus norvegicus
tttcagggccctttgacaattaaag

SEQ ID NO: 689523 - DNA, 25 bp, Rattus norvegicus
tttcagggtcctacgtgaacagaca

SEQ ID NO: 689524 - DNA, 25 bp, Rattus norvegicus
tttcagggtccttcgtgaacagaca

SEQ ID NO: 689525 - DNA, 25 bp, Rattus norvegicus
tttcaggtactgatgacatacattt

SEQ ID NO: 689526 - DNA, 25 bp, Rattus norvegicus
tttcaggtactgttgacatacattt

SEQ ID NO: 689527 - DNA, 25 bp, Rattus norvegicus
tttcaggtcttgagtgcccactaat

SEQ ID NO: 689528 - DNA, 25 bp, Rattus norvegicus
tttcaggtcttgtgtgcccactaat

SEQ ID NO: 689529 - DNA, 25 bp, Rattus norvegicus
tttcaggtgatgactgtgagcccag

SEQ ID NO: 689530 - DNA, 25 bp, Rattus norvegicus
tttcaggtgatgtctgtgagcccag

SEQ ID NO: 689531 - DNA, 25 bp, Rattus norvegicus
tttcaggttcttctttaagtacatt

SEQ ID NO: 689532 - DNA, 25 bp, Rattus norvegicus
tttcaggttcttgtttaagtacatt

SEQ ID NO: 689533 - DNA, 25 bp, Rattus norvegicus
tttcaggtttttcagccgagccgag

SEQ ID NO: 689534 - DNA, 25 bp, Rattus norvegicus
tttcaggtttttgagccgagccgag

SEQ ID NO: 689535 - DNA, 25 bp, Rattus norvegicus
tttcagtaaccgcatgggaagctta

SEQ ID NO: 689536 - DNA, 25 bp, Rattus norvegicus
tttcagtaaccggatgggaagctta

SEQ ID NO: 689537 - DNA, 25 bp, Rattus norvegicus
tttcagtaacttcccactatgaccc

SEQ ID NO: 689538 - DNA, 25 bp, Rattus norvegicus
tttcagtaacttgccactatgaccc

SEQ ID NO: 689539 - DNA, 25 bp, Rattus norvegicus
tttcagtaattcatgcctcttctct

SEQ ID NO: 689540 - DNA, 25 bp, Rattus norvegicus
tttcagtaattcttgcctcttctct

SEQ ID NO: 689541 - DNA, 25 bp, Rattus norvegicus
tttcagtacccactgggctggccac

SEQ ID NO: 689542 - DNA, 25 bp, Rattus norvegicus
tttcagtacccagtgggctggccac

SEQ ID NO: 689543 - DNA, 25 bp, Rattus norvegicus
tttcagtatcaaagtggttccccat

SEQ ID NO: 689544 - DNA, 25 bp, Rattus norvegicus
tttcagtatcaatgtggttccccat

SEQ ID NO: 689545 - DNA, 25 bp, Rattus norvegicus
tttcagtcaaaaagtctgttgcaca

SEQ ID NO: 689546 - DNA, 25 bp, Rattus norvegicus
tttcagtcaaaatgtctgttgcaca

SEQ ID NO: 689547 - DNA, 25 bp, Rattus norvegicus
tttcagtcatgaatccaccctagtg

SEQ ID NO: 689548 - DNA, 25 bp, Rattus norvegicus
tttcagtcatgattccaccctagtg

SEQ ID NO: 689549 - DNA, 25 bp, Rattus norvegicus
tttcagtccctgattgtatttcttc

SEQ ID NO: 689550 - DNA, 25 bp, Rattus norvegicus
tttcagtccctgtttgtatttcttc

SEQ ID NO: 689551 - DNA, 25 bp, Rattus norvegicus
tttcagtccgtgaggccaaagccat

SEQ ID NO: 689552 - DNA, 25 bp, Rattus norvegicus
tttcagtccgtgtggccaaagccat

SEQ ID NO: 689553 - DNA, 25 bp, Rattus norvegicus
tttcagtctgttatcacctcagctg

SEQ ID NO: 689554 - DNA, 25 bp, Rattus norvegicus
tttcagtctgttttcacctcagctg

SEQ ID NO: 689555 - DNA, 25 bp, Rattus norvegicus
tttcagtgcttcaaactctggctgt

SEQ ID NO: 689556 - DNA, 25 bp, Rattus norvegicus
tttcagtgcttctaactctggctgt

SEQ ID NO: 689557 - DNA, 25 bp, Rattus norvegicus
tttcagtggaacaggcttcttccct

SEQ ID NO: 689558 - DNA, 25 bp, Rattus norvegicus
tttcagtggaactggcttcttccct

SEQ ID NO: 689559 - DNA, 25 bp, Rattus norvegicus
tttcagtggagcacagcagacgctt

SEQ ID NO: 689560 - DNA, 25 bp, Rattus norvegicus
tttcagtggagctcagcagacgctt

SEQ ID NO: 689561 - DNA, 25 bp, Rattus norvegicus
tttcagtggccaaactgtcagctgt

SEQ ID NO: 689562 - DNA, 25 bp, Rattus norvegicus
tttcagtggccatactgtcagctgt

SEQ ID NO: 689563 - DNA, 25 bp, Rattus norvegicus
tttcagtggctcatgtaggtcttgc

SEQ ID NO: 689564 - DNA, 25 bp, Rattus norvegicus
tttcagtggctcttgtaggtcttgc

SEQ ID NO: 689565 - DNA, 25 bp, Rattus norvegicus
tttcagtgtataaggcttgcttgca

SEQ ID NO: 689566 - DNA, 25 bp, Rattus norvegicus
tttcagtgtatatggcttgcttgca

SEQ ID NO: 689567 - DNA, 25 bp, Rattus norvegicus
tttcagtgtgaacccagagcttgtc

SEQ ID NO: 689568 - DNA, 25 bp, Rattus norvegicus
tttcagtgtgaagccagagcttgtc

SEQ ID NO: 689569 - DNA, 25 bp, Rattus norvegicus
tttcagtgttttccctttcaaggtg

SEQ ID NO: 689570 - DNA, 25 bp, Rattus norvegicus
tttcagtgttttgcctttcaaggtg

SEQ ID NO: 689571 - DNA, 25 bp, Rattus norvegicus
tttcagttactaaaagcctgcttaa

SEQ ID NO: 689572 - DNA, 25 bp, Rattus norvegicus
tttcagttactataagcctgcttaa

SEQ ID NO: 689573 - DNA, 25 bp, Rattus norvegicus
tttcagttacttctgggcctgagca

SEQ ID NO: 689574 - DNA, 25 bp, Rattus norvegicus
tttcagttacttgtgggcctgagca

SEQ ID NO: 689575 - DNA, 25 bp, Rattus norvegicus
tttcagttatccatgcctccaaata

SEQ ID NO: 689576 - DNA, 25 bp, Rattus norvegicus
tttcagttatccttgcctccaaata

SEQ ID NO: 689577 - DNA, 25 bp, Rattus norvegicus
tttcagttatctatcagctctgccc

SEQ ID NO: 689578 - DNA, 25 bp, Rattus norvegicus
tttcagttatctttcagctctgccc

SEQ ID NO: 689579 - DNA, 25 bp, Rattus norvegicus
tttcagttcaagaagctccagcaag

SEQ ID NO: 689580 - DNA, 25 bp, Rattus norvegicus
tttcagttcaagtagctccagcaag

SEQ ID NO: 689581 - DNA, 25 bp, Rattus norvegicus
tttcagttctccagctaagcattgc

SEQ ID NO: 689582 - DNA, 25 bp, Rattus norvegicus
tttcagttctcctgctaagcattgc

SEQ ID NO: 689583 - DNA, 25 bp, Rattus norvegicus
tttcagttgaacacgtgcgcatttc

SEQ ID NO: 689584 - DNA, 25 bp, Rattus norvegicus
tttcagttgaactcgtgcgcatttc

SEQ ID NO: 689585 - DNA, 25 bp, Rattus norvegicus
tttcagttgggtcagattgttcttt

SEQ ID NO: 689586 - DNA, 25 bp, Rattus norvegicus
tttcagttgggtgagattgttcttt

SEQ ID NO: 689587 - DNA, 25 bp, Rattus norvegicus
tttcagtttaacaaccagacacaaa

SEQ ID NO: 689588 - DNA, 25 bp, Rattus norvegicus
tttcagtttaactaccagacacaaa

SEQ ID NO: 689589 - DNA, 25 bp, Rattus norvegicus
tttcagttttctcccaaggtctcct

SEQ ID NO: 689590 - DNA, 25 bp, Rattus norvegicus
tttcagttttctgccaaggtctcct

SEQ ID NO: 689591 - DNA, 25 bp, Rattus norvegicus
tttcataaatatcttcacacgactc

SEQ ID NO: 689592 - DNA, 25 bp, Rattus norvegicus
tttcataaatatgttcacacgactc

SEQ ID NO: 689593 - DNA, 25 bp, Rattus norvegicus
tttcataagttcaggagtaagacat

SEQ ID NO: 689594 - DNA, 25 bp, Rattus norvegicus
tttcataagttctggagtaagacat

SEQ ID NO: 689595 - DNA, 25 bp, Rattus norvegicus
tttcataatcccaagcctgtcggct

SEQ ID NO: 689596 - DNA, 25 bp, Rattus norvegicus
tttcataatccctagcctgtcggct

SEQ ID NO: 689597 - DNA, 25 bp, Rattus norvegicus
tttcatacaactcacgaccttaacg

SEQ ID NO: 689598 - DNA, 25 bp, Rattus norvegicus
tttcatacaactgacgaccttaacg

SEQ ID NO: 689599 - DNA, 25 bp, Rattus norvegicus
tttcatacactcagcgatccgttgc

SEQ ID NO: 689600 - DNA, 25 bp, Rattus norvegicus
tttcatacactctgcgatccgttgc

SEQ ID NO: 689601 - DNA, 25 bp, Rattus norvegicus
tttcataccagtctcttctcgggct

SEQ ID NO: 689602 - DNA, 25 bp, Rattus norvegicus
tttcataccagtgtcttctcgggct

SEQ ID NO: 689603 - DNA, 25 bp, Rattus norvegicus
tttcatactgtcatgggccagggcc

SEQ ID NO: 689604 - DNA, 25 bp, Rattus norvegicus
tttcatactgtcttgggccagggcc

SEQ ID NO: 689605 - DNA, 25 bp, Rattus norvegicus
tttcatagctctcggacacgtgtca

SEQ ID NO: 689606 - DNA, 25 bp, Rattus norvegicus
tttcatagctctgggacacgtgtca

SEQ ID NO: 689607 - DNA, 25 bp, Rattus norvegicus
tttcataggctaatccagtttgtat

SEQ ID NO: 689608 - DNA, 25 bp, Rattus norvegicus
tttcataggctattccagtttgtat

SEQ ID NO: 689609 - DNA, 25 bp, Rattus norvegicus
tttcatataggaaggctcggagctt

SEQ ID NO: 689610 - DNA, 25 bp, Rattus norvegicus
tttcatataggatggctcggagctt

SEQ ID NO: 689611 - DNA, 25 bp, Rattus norvegicus
tttcatatcgatctccataatcaca

SEQ ID NO: 689612 - DNA, 25 bp, Rattus norvegicus
tttcatatcgatgtccataatcaca

SEQ ID NO: 689613 - DNA, 25 bp, Rattus norvegicus
tttcatatgtaaccctggacactgg

SEQ ID NO: 689614 - DNA, 25 bp, Rattus norvegicus
tttcatatgtaagcctggacactgg

SEQ ID NO: 689615 - DNA, 25 bp, Rattus norvegicus
tttcatcaacaaaaaggcctttcca

SEQ ID NO: 689616 - DNA, 25 bp, Rattus norvegicus
tttcatcaacaataaggcctttcca

SEQ ID NO: 689617 - DNA, 25 bp, Rattus norvegicus
tttcatcacgaaccatgtcttctgc

SEQ ID NO: 689618 - DNA, 25 bp, Rattus norvegicus
tttcatcacgaagcatgtcttctgc

SEQ ID NO: 689619 - DNA, 25 bp, Rattus norvegicus
tttcatcactcaatccggactttta

SEQ ID NO: 689620 - DNA, 25 bp, Rattus norvegicus
tttcatcactcattccggactttta

SEQ ID NO: 689621 - DNA, 25 bp, Rattus norvegicus
tttcatcatgtgctgtgcttggacc

SEQ ID NO: 689622 - DNA, 25 bp, Rattus norvegicus
tttcatcatgtggtgtgcttggacc

SEQ ID NO: 689623 - DNA, 25 bp, Rattus norvegicus
tttcatccaatgatcggtatcctaa

SEQ ID NO: 689624 - DNA, 25 bp, Rattus norvegicus
tttcatccaatgttcggtatcctaa

SEQ ID NO: 689625 - DNA, 25 bp, Rattus norvegicus
tttcatccagcacgctagtgggact

SEQ ID NO: 689626 - DNA, 25 bp, Rattus norvegicus
tttcatccagcaggctagtgggact

SEQ ID NO: 689627 - DNA, 25 bp, Rattus norvegicus
tttcatccagtaatgcatagcttta

SEQ ID NO: 689628 - DNA, 25 bp, Rattus norvegicus
tttcatccagtattgcatagcttta

SEQ ID NO: 689629 - DNA, 25 bp, Rattus norvegicus
tttcatcccagcaaatggcttctta

SEQ ID NO: 689630 - DNA, 25 bp, Rattus norvegicus
tttcatcccagctaatggcttctta

SEQ ID NO: 689631 - DNA, 25 bp, Rattus norvegicus
tttcatccccttcgtgtcaatcaaa

SEQ ID NO: 689632 - DNA, 25 bp, Rattus norvegicus
tttcatccccttggtgtcaatcaaa

SEQ ID NO: 689633 - DNA, 25 bp, Rattus norvegicus
tttcatcccggacatcagtgggctg

SEQ ID NO: 689634 - DNA, 25 bp, Rattus norvegicus
tttcatcccggagatcagtgggctg

SEQ ID NO: 689635 - DNA, 25 bp, Rattus norvegicus
tttcatccctggcttattttgtggc

SEQ ID NO: 689636 - DNA, 25 bp, Rattus norvegicus
tttcatccctgggttattttgtggc

SEQ ID NO: 689637 - DNA, 25 bp, Rattus norvegicus
tttcatccgttcctaccaggcttat

SEQ ID NO: 689638 - DNA, 25 bp, Rattus norvegicus
tttcatccgttcgtaccaggcttat

SEQ ID NO: 689639 - DNA, 25 bp, Rattus norvegicus
tttcatcctctgacactgcatcggt

SEQ ID NO: 689640 - DNA, 25 bp, Rattus norvegicus
tttcatcctctgtcactgcatcggt

SEQ ID NO: 689641 - DNA, 25 bp, Rattus norvegicus
tttcatcctgctcccgggggcggct

SEQ ID NO: 689642 - DNA, 25 bp, Rattus norvegicus
tttcatcctgctgccgggggcggct

SEQ ID NO: 689643 - DNA, 25 bp, Rattus norvegicus
tttcatcgggataccaggatggcag

SEQ ID NO: 689644 - DNA, 25 bp, Rattus norvegicus
tttcatcgggattccaggatggcag

SEQ ID NO: 689645 - DNA, 25 bp, Rattus norvegicus
tttcatcgggccctaaaagtaatga

SEQ ID NO: 689646 - DNA, 25 bp, Rattus norvegicus
tttcatcgggccgtaaaagtaatga

SEQ ID NO: 689647 - DNA, 25 bp, Rattus norvegicus
tttcatcggtggctaaatcgcatca

SEQ ID NO: 689648 - DNA, 25 bp, Rattus norvegicus
tttcatcggtgggtaaatcgcatca

SEQ ID NO: 689649 - DNA, 25 bp, Rattus norvegicus
tttcatctactactatgtgtcccac

SEQ ID NO: 689650 - DNA, 25 bp, Rattus norvegicus
tttcatctactagtatgtgtcccac

SEQ ID NO: 689651 - DNA, 25 bp, Rattus norvegicus
tttcatctactgactcctggaagtg

SEQ ID NO: 689652 - DNA, 25 bp, Rattus norvegicus
tttcatctactgtctcctggaagtg

SEQ ID NO: 689653 - DNA, 25 bp, Rattus norvegicus
tttcatctcaccaggagccttggca

SEQ ID NO: 689654 - DNA, 25 bp, Rattus norvegicus
tttcatctcacctggagccttggca

SEQ ID NO: 689655 - DNA, 25 bp, Rattus norvegicus
tttcatctcagtattaccctgactg

SEQ ID NO: 689656 - DNA, 25 bp, Rattus norvegicus
tttcatctcagttttaccctgactg

SEQ ID NO: 689657 - DNA, 25 bp, Rattus norvegicus
tttcatctccaaagcccatatcatg

SEQ ID NO: 689658 - DNA, 25 bp, Rattus norvegicus
tttcatctccaatgcccatatcatg

SEQ ID NO: 689659 - DNA, 25 bp, Rattus norvegicus
tttcatctcttgctgaagccgagtt

SEQ ID NO: 689660 - DNA, 25 bp, Rattus norvegicus
tttcatctcttggtgaagccgagtt

SEQ ID NO: 689661 - DNA, 25 bp, Rattus norvegicus
tttcatctgattagtccggaggctc

SEQ ID NO: 689662 - DNA, 25 bp, Rattus norvegicus
tttcatctgatttgtccggaggctc

SEQ ID NO: 689663 - DNA, 25 bp, Rattus norvegicus
tttcatctgcaacctaactttccag

SEQ ID NO: 689664 - DNA, 25 bp, Rattus norvegicus
tttcatctgcaagctaactttccag

SEQ ID NO: 689665 - DNA, 25 bp, Rattus norvegicus
tttcatctggataccctcaaaggag

SEQ ID NO: 689666 - DNA, 25 bp, Rattus norvegicus
tttcatctggattccctcaaaggag

SEQ ID NO: 689667 - DNA, 25 bp, Rattus norvegicus
tttcatctgtttcaccatgtgacgg

SEQ ID NO: 689668 - DNA, 25 bp, Rattus norvegicus
tttcatctgtttgaccatgtgacgg

SEQ ID NO: 689669 - DNA, 25 bp, Rattus norvegicus
tttcatcttgccctcgatgatctgg

SEQ ID NO: 689670 - DNA, 25 bp, Rattus norvegicus
tttcatcttgccgtcgatgatctgg

SEQ ID NO: 689671 - DNA, 25 bp, Rattus norvegicus
tttcatcttgttcaaagctgcctgc

SEQ ID NO: 689672 - DNA, 25 bp, Rattus norvegicus
tttcatcttgttgaaagctgcctgc

SEQ ID NO: 689673 - DNA, 25 bp, Rattus norvegicus
tttcatgaacgtctgcttctttcca

SEQ ID NO: 689674 - DNA, 25 bp, Rattus norvegicus
tttcatgaacgtgtgcttctttcca

SEQ ID NO: 689675 - DNA, 25 bp, Rattus norvegicus
tttcatgaccatcgctgacatccag

SEQ ID NO: 689676 - DNA, 25 bp, Rattus norvegicus
tttcatgaccatggctgacatccag

SEQ ID NO: 689677 - DNA, 25 bp, Rattus norvegicus
tttcatgagaaaaggcacaactaat

SEQ ID NO: 689678 - DNA, 25 bp, Rattus norvegicus
tttcatgagaaacggcactactggg

SEQ ID NO: 689679 - DNA, 25 bp, Rattus norvegicus
tttcatgagaaagggcactactggg

SEQ ID NO: 689680 - DNA, 25 bp, Rattus norvegicus
tttcatgagaaatggcacaactaat

SEQ ID NO: 689681 - DNA, 25 bp, Rattus norvegicus
tttcatgagctcagtgattaccaag

SEQ ID NO: 689682 - DNA, 25 bp, Rattus norvegicus
tttcatgagctctgtgattaccaag

SEQ ID NO: 689683 - DNA, 25 bp, Rattus norvegicus
tttcatgataaaactcccctggctt

SEQ ID NO: 689684 - DNA, 25 bp, Rattus norvegicus
tttcatgataaatctcccctggctt

SEQ ID NO: 689685 - DNA, 25 bp, Rattus norvegicus
tttcatgcaaagacaacctccggga

SEQ ID NO: 689686 - DNA, 25 bp, Rattus norvegicus
tttcatgcaaagtcaacctccggga

SEQ ID NO: 689687 - DNA, 25 bp, Rattus norvegicus
tttcatgccatgatacttctcagtc

SEQ ID NO: 689688 - DNA, 25 bp, Rattus norvegicus
tttcatgccatgttacttctcagtc

SEQ ID NO: 689689 - DNA, 25 bp, Rattus norvegicus
tttcatgccctcacctgcgtattga

SEQ ID NO: 689690 - DNA, 25 bp, Rattus norvegicus
tttcatgccctctcctgcgtattga

SEQ ID NO: 689691 - DNA, 25 bp, Rattus norvegicus
tttcatgcctgcagcacgtttgtat

SEQ ID NO: 689692 - DNA, 25 bp, Rattus norvegicus
tttcatgcctgctgcacgtttgtat

SEQ ID NO: 689693 - DNA, 25 bp, Rattus norvegicus
tttcatgcgcttacatttgttggta

SEQ ID NO: 689694 - DNA, 25 bp, Rattus norvegicus
tttcatgcgctttcatttgttggta

SEQ ID NO: 689695 - DNA, 25 bp, Rattus norvegicus
tttcatgctcctccatgttcattag

SEQ ID NO: 689696 - DNA, 25 bp, Rattus norvegicus
tttcatgctcctgcatgttcattag

SEQ ID NO: 689697 - DNA, 25 bp, Rattus norvegicus
tttcatgctgatctgattgcccata

SEQ ID NO: 689698 - DNA, 25 bp, Rattus norvegicus
tttcatgctgatgtgattgcccata

SEQ ID NO: 689699 - DNA, 25 bp, Rattus norvegicus
tttcatgcttaaaatgaccagtgtt

SEQ ID NO: 689700 - DNA, 25 bp, Rattus norvegicus
tttcatgcttaatatgaccagtgtt

SEQ ID NO: 689701 - DNA, 25 bp, Rattus norvegicus
tttcatgcttgtagaggcctcggca

SEQ ID NO: 689702 - DNA, 25 bp, Rattus norvegicus
tttcatgcttgttgaggcctcggca

SEQ ID NO: 689703 - DNA, 25 bp, Rattus norvegicus
tttcatggagccctctacatctaag

SEQ ID NO: 689704 - DNA, 25 bp, Rattus norvegicus
tttcatggagccgtctacatctaag

SEQ ID NO: 689705 - DNA, 25 bp, Rattus norvegicus
tttcatggagctcaagtgtgacctt

SEQ ID NO: 689706 - DNA, 25 bp, Rattus norvegicus
tttcatggagctgaagtgtgacctt

SEQ ID NO: 689707 - DNA, 25 bp, Rattus norvegicus
tttcatggctttcactctatgtgga

SEQ ID NO: 689708 - DNA, 25 bp, Rattus norvegicus
tttcatggctttgactctatgtgga

SEQ ID NO: 689709 - DNA, 25 bp, Rattus norvegicus
tttcatgggctactctatgactgcc

SEQ ID NO: 689710 - DNA, 25 bp, Rattus norvegicus
tttcatgggctagtctatgactgcc

SEQ ID NO: 689711 - DNA, 25 bp, Rattus norvegicus
tttcatggtcccagagaagcttgca

SEQ ID NO: 689712 - DNA, 25 bp, Rattus norvegicus
tttcatggtccctgagaagcttgca

SEQ ID NO: 689713 - DNA, 25 bp, Rattus norvegicus
tttcatggtgtcctcctacgtaatt

SEQ ID NO: 689714 - DNA, 25 bp, Rattus norvegicus
tttcatggtgtcgtcctacgtaatt

SEQ ID NO: 689715 - DNA, 25 bp, Rattus norvegicus
tttcatgtaaccacaagatccttgg

SEQ ID NO: 689716 - DNA, 25 bp, Rattus norvegicus
tttcatgtaacctcaagatccttgg

SEQ ID NO: 689717 - DNA, 25 bp, Rattus norvegicus
tttcatgtggcgactccagaaggca

SEQ ID NO: 689718 - DNA, 25 bp, Rattus norvegicus
tttcatgtggcgtctccagaaggca

SEQ ID NO: 689719 - DNA, 25 bp, Rattus norvegicus
tttcatgttaaacctgccatttccc

SEQ ID NO: 689720 - DNA, 25 bp, Rattus norvegicus
tttcatgttaaagctgccatttccc

SEQ ID NO: 689721 - DNA, 25 bp, Rattus norvegicus
tttcatgttatcatttactgtctgt

SEQ ID NO: 689722 - DNA, 25 bp, Rattus norvegicus
tttcatgttatcttttactgtctgt

SEQ ID NO: 689723 - DNA, 25 bp, Rattus norvegicus
tttcatgttctcataatcaccctgt

SEQ ID NO: 689724 - DNA, 25 bp, Rattus norvegicus
tttcatgttctcttaatcaccctgt

SEQ ID NO: 689725 - DNA, 25 bp, Rattus norvegicus
tttcatgttgacaggaccgctgggc

SEQ ID NO: 689726 - DNA, 25 bp, Rattus norvegicus
tttcatgttgactggaccgctgggc

SEQ ID NO: 689727 - DNA, 25 bp, Rattus norvegicus
tttcatgtttccatcatcatacggg

SEQ ID NO: 689728 - DNA, 25 bp, Rattus norvegicus
tttcatgtttccttcatcatacggg

SEQ ID NO: 689729 - DNA, 25 bp, Rattus norvegicus
tttcattaacctcctttacaagatc

SEQ ID NO: 689730 - DNA, 25 bp, Rattus norvegicus
tttcattaacctgctttacaagatc

SEQ ID NO: 689731 - DNA, 25 bp, Rattus norvegicus
tttcattacacaaggaattcagctt

SEQ ID NO: 689732 - DNA, 25 bp, Rattus norvegicus
tttcattacacatggaattcagctt

SEQ ID NO: 689733 - DNA, 25 bp, Rattus norvegicus
tttcattagcagaccatcagccatc

SEQ ID NO: 689734 - DNA, 25 bp, Rattus norvegicus
tttcattagcagtccatcagccatc

SEQ ID NO: 689735 - DNA, 25 bp, Rattus norvegicus
tttcattcaacaccccttgcagagg

SEQ ID NO: 689736 - DNA, 25 bp, Rattus norvegicus
tttcattcaacagcccttgcagagg

SEQ ID NO: 689737 - DNA, 25 bp, Rattus norvegicus
tttcattcagtacttctcagccctt

SEQ ID NO: 689738 - DNA, 25 bp, Rattus norvegicus
tttcattcagtagttctcagccctt

SEQ ID NO: 689739 - DNA, 25 bp, Rattus norvegicus
tttcattcccctaatgtccagagac

SEQ ID NO: 689740 - DNA, 25 bp, Rattus norvegicus
tttcattccccttatgtccagagac

SEQ ID NO: 689741 - DNA, 25 bp, Rattus norvegicus
tttcattccctaccctcataataaa

SEQ ID NO: 689742 - DNA, 25 bp, Rattus norvegicus
tttcattccctagcctcataataaa

SEQ ID NO: 689743 - DNA, 25 bp, Rattus norvegicus
tttcattccctgaagttaattctgc

SEQ ID NO: 689744 - DNA, 25 bp, Rattus norvegicus
tttcattccctgtagttaattctgc

SEQ ID NO: 689745 - DNA, 25 bp, Rattus norvegicus
tttcattcgggccatcgtgattcct

SEQ ID NO: 689746 - DNA, 25 bp, Rattus norvegicus
tttcattcgggcgatcgtgattcct

SEQ ID NO: 689747 - DNA, 25 bp, Rattus norvegicus
tttcattctaacattcgatattctt

SEQ ID NO: 689748 - DNA, 25 bp, Rattus norvegicus
tttcattctaactttcgatattctt

SEQ ID NO: 689749 - DNA, 25 bp, Rattus norvegicus
tttcattgctagcaggccactgtca

SEQ ID NO: 689750 - DNA, 25 bp, Rattus norvegicus
tttcattgctaggaggccactgtca

SEQ ID NO: 689751 - DNA, 25 bp, Rattus norvegicus
tttcattgtcctatgctcttgtagg

SEQ ID NO: 689752 - DNA, 25 bp, Rattus norvegicus
tttcattgtcctttgctcttgtagg

SEQ ID NO: 689753 - DNA, 25 bp, Rattus norvegicus
tttcattgtgacatcataattgcaa

SEQ ID NO: 689754 - DNA, 25 bp, Rattus norvegicus
tttcattgtgacttcataattgcaa

SEQ ID NO: 689755 - DNA, 25 bp, Rattus norvegicus
tttcattgtgttaatcgcggcctcc

SEQ ID NO: 689756 - DNA, 25 bp, Rattus norvegicus
tttcattgtgtttatcgcggcctcc

SEQ ID NO: 689757 - DNA, 25 bp, Rattus norvegicus
tttcatttcagtagcttttgccaag

SEQ ID NO: 689758 - DNA, 25 bp, Rattus norvegicus
tttcatttcagttgcttttgccaag

SEQ ID NO: 689759 - DNA, 25 bp, Rattus norvegicus
tttcatttctcaaacatgcagcgat

SEQ ID NO: 689760 - DNA, 25 bp, Rattus norvegicus
tttcatttctcatacatgcagcgat

SEQ ID NO: 689761 - DNA, 25 bp, Rattus norvegicus
tttcatttctgtaggtctctgttgt

SEQ ID NO: 689762 - DNA, 25 bp, Rattus norvegicus
tttcatttctgtctattggccgaat

SEQ ID NO: 689763 - DNA, 25 bp, Rattus norvegicus
tttcatttctgtgtattggccgaat

SEQ ID NO: 689764 - DNA, 25 bp, Rattus norvegicus
tttcatttctgttggtctctgttgt

SEQ ID NO: 689765 - DNA, 25 bp, Rattus norvegicus
tttcatttgcatacgagcccttctt

SEQ ID NO: 689766 - DNA, 25 bp, Rattus norvegicus
tttcatttgcattcgagcccttctt

SEQ ID NO: 689767 - DNA, 25 bp, Rattus norvegicus
tttcatttgcttaccgtgcccagga

SEQ ID NO: 689768 - DNA, 25 bp, Rattus norvegicus
tttcatttgctttccgtgcccagga

SEQ ID NO: 689769 - DNA, 25 bp, Rattus norvegicus
tttcatttgtagagagacaaggcta

SEQ ID NO: 689770 - DNA, 25 bp, Rattus norvegicus
tttcatttgtagtgagacaaggcta

SEQ ID NO: 689771 - DNA, 25 bp, Rattus norvegicus
tttcattttataaatacactgcgtt

SEQ ID NO: 689772 - DNA, 25 bp, Rattus norvegicus
tttcattttatatatacactgcgtt

SEQ ID NO: 689773 - DNA, 25 bp, Rattus norvegicus
tttcattttctcctgcattggcaat

SEQ ID NO: 689774 - DNA, 25 bp, Rattus norvegicus
tttcattttctcgtgcattggcaat

SEQ ID NO: 689775 - DNA, 25 bp, Rattus norvegicus
tttcattttgcgatttttccctcca

SEQ ID NO: 689776 - DNA, 25 bp, Rattus norvegicus
tttcattttgcgttttttccctcca

SEQ ID NO: 689777 - DNA, 25 bp, Rattus norvegicus
tttcattttggacctgattgggcga

SEQ ID NO: 689778 - DNA, 25 bp, Rattus norvegicus
tttcattttggagctgattgggcga

SEQ ID NO: 689779 - DNA, 25 bp, Rattus norvegicus
tttccaaaacagaccgagaatatca

SEQ ID NO: 689780 - DNA, 25 bp, Rattus norvegicus
tttccaaaacagtccgagaatatca

SEQ ID NO: 689781 - DNA, 25 bp, Rattus norvegicus
tttccaaaagataatgcctggcaga

SEQ ID NO: 689782 - DNA, 25 bp, Rattus norvegicus
tttccaaaagattatgcctggcaga

SEQ ID NO: 689783 - DNA, 25 bp, Rattus norvegicus
tttccaaaaggtcagccggagccct

SEQ ID NO: 689784 - DNA, 25 bp, Rattus norvegicus
tttccaaaaggtgagccggagccct

SEQ ID NO: 689785 - DNA, 25 bp, Rattus norvegicus
tttccaaaagtcctcgttgccgtgg

SEQ ID NO: 689786 - DNA, 25 bp, Rattus norvegicus
tttccaaaagtcgtcgttgccgtgg

SEQ ID NO: 689787 - DNA, 25 bp, Rattus norvegicus
tttccaaaccgaagggctgtctccg

SEQ ID NO: 689788 - DNA, 25 bp, Rattus norvegicus
tttccaaaccgatgggctgtctccg

SEQ ID NO: 689789 - DNA, 25 bp, Rattus norvegicus
tttccaaactttccagtaagcaggt

SEQ ID NO: 689790 - DNA, 25 bp, Rattus norvegicus
tttccaaactttgcagtaagcaggt

SEQ ID NO: 689791 - DNA, 25 bp, Rattus norvegicus
tttccaaagctgagaggcttcagtt

SEQ ID NO: 689792 - DNA, 25 bp, Rattus norvegicus
tttccaaagctgtgaggcttcagtt

SEQ ID NO: 689793 - DNA, 25 bp, Rattus norvegicus
tttccaaagttcagacctagggcct

SEQ ID NO: 689794 - DNA, 25 bp, Rattus norvegicus
tttccaaagttctgacctagggcct

SEQ ID NO: 689795 - DNA, 25 bp, Rattus norvegicus
tttccaaatcaacacttctccttat

SEQ ID NO: 689796 - DNA, 25 bp, Rattus norvegicus
tttccaaatcaagacttctccttat

SEQ ID NO: 689797 - DNA, 25 bp, Rattus norvegicus
tttccaaatcacatctgcctgtctg

SEQ ID NO: 689798 - DNA, 25 bp, Rattus norvegicus
tttccaaatcacttctgcctgtctg

SEQ ID NO: 689799 - DNA, 25 bp, Rattus norvegicus
tttccaaatctcagaaacagtggga

SEQ ID NO: 689800 - DNA, 25 bp, Rattus norvegicus
tttccaaatctctgaaacagtggga

SEQ ID NO: 689801 - DNA, 25 bp, Rattus norvegicus
tttccaacaagcacgcggcgtcgaa

SEQ ID NO: 689802 - DNA, 25 bp, Rattus norvegicus
tttccaacaagctcgcggcgtcgaa

SEQ ID NO: 689803 - DNA, 25 bp, Rattus norvegicus
tttccaacgcggatgcggctgcgag

SEQ ID NO: 689804 - DNA, 25 bp, Rattus norvegicus
tttccaacgcggttgcggctgcgag

SEQ ID NO: 689805 - DNA, 25 bp, Rattus norvegicus
tttccaacttcacttactgctctca

SEQ ID NO: 689806 - DNA, 25 bp, Rattus norvegicus
tttccaacttcagttactgctctca

SEQ ID NO: 689807 - DNA, 25 bp, Rattus norvegicus
tttccaagaatacacaccacatccg

SEQ ID NO: 689808 - DNA, 25 bp, Rattus norvegicus
tttccaagaatagacaccacatccg

SEQ ID NO: 689809 - DNA, 25 bp, Rattus norvegicus
tttccaagacttcagctgctgtggt

SEQ ID NO: 689810 - DNA, 25 bp, Rattus norvegicus
tttccaagacttgagctgctgtggt

SEQ ID NO: 689811 - DNA, 25 bp, Rattus norvegicus
tttccaagagccatatctcgctaag

SEQ ID NO: 689812 - DNA, 25 bp, Rattus norvegicus
tttccaagagccttatctcgctaag

SEQ ID NO: 689813 - DNA, 25 bp, Rattus norvegicus
tttccaagatgacagcacacagcgt

SEQ ID NO: 689814 - DNA, 25 bp, Rattus norvegicus
tttccaagatgagagcacacagcgt

SEQ ID NO: 689815 - DNA, 25 bp, Rattus norvegicus
tttccaagcacaactgggcagatct

SEQ ID NO: 689816 - DNA, 25 bp, Rattus norvegicus
tttccaagcacatctgggcagatct

SEQ ID NO: 689817 - DNA, 25 bp, Rattus norvegicus
tttccaagcagtcgtctggttttgt

SEQ ID NO: 689818 - DNA, 25 bp, Rattus norvegicus
tttccaagcagtggtctggttttgt

SEQ ID NO: 689819 - DNA, 25 bp, Rattus norvegicus
tttccaagctggaccccaaggtgaa

SEQ ID NO: 689820 - DNA, 25 bp, Rattus norvegicus
tttccaagctggtccccaaggtgaa

SEQ ID NO: 689821 - DNA, 25 bp, Rattus norvegicus
tttccaaggaatacgcagggcctga

SEQ ID NO: 689822 - DNA, 25 bp, Rattus norvegicus
tttccaaggaattcgcagggcctga

SEQ ID NO: 689823 - DNA, 25 bp, Rattus norvegicus
tttccaaggagacttctttctttgt

SEQ ID NO: 689824 - DNA, 25 bp, Rattus norvegicus
tttccaaggagagttctttctttgt

SEQ ID NO: 689825 - DNA, 25 bp, Rattus norvegicus
tttccaaggcctcgtgtgtgtccat

SEQ ID NO: 689826 - DNA, 25 bp, Rattus norvegicus
tttccaaggcctggtgtgtgtccat

SEQ ID NO: 689827 - DNA, 25 bp, Rattus norvegicus
tttccaaggtatcctcctggttcaa

SEQ ID NO: 689828 - DNA, 25 bp, Rattus norvegicus
tttccaaggtatgctcctggttcaa

SEQ ID NO: 689829 - DNA, 25 bp, Rattus norvegicus
tttccaagtgtgagaggtttcgtca

SEQ ID NO: 689830 - DNA, 25 bp, Rattus norvegicus
tttccaagtgtgtgaggtttcgtca

SEQ ID NO: 689831 - DNA, 25 bp, Rattus norvegicus
tttccaatagcccagagatgtcaag

SEQ ID NO: 689832 - DNA, 25 bp, Rattus norvegicus
tttccaatagccgagagatgtcaag

SEQ ID NO: 689833 - DNA, 25 bp, Rattus norvegicus
tttccaatccagctgttggtgtttc

SEQ ID NO: 689834 - DNA, 25 bp, Rattus norvegicus
tttccaatccaggtgttggtgtttc

SEQ ID NO: 689835 - DNA, 25 bp, Rattus norvegicus
tttccaatgaacaggaggctgctcc

SEQ ID NO: 689836 - DNA, 25 bp, Rattus norvegicus
tttccaatgaactggaggctgctcc

SEQ ID NO: 689837 - DNA, 25 bp, Rattus norvegicus
tttccaatgtgtagaattattcctt

SEQ ID NO: 689838 - DNA, 25 bp, Rattus norvegicus
tttccaatgtgttgaattattcctt

SEQ ID NO: 689839 - DNA, 25 bp, Rattus norvegicus
tttccacaaactagtttcttctcct

SEQ ID NO: 689840 - DNA, 25 bp, Rattus norvegicus
tttccacaaacttgtttcttctcct

SEQ ID NO: 689841 - DNA, 25 bp, Rattus norvegicus
tttccacagcagctgcttgcacagg

SEQ ID NO: 689842 - DNA, 25 bp, Rattus norvegicus
tttccacagcaggtgcttgcacagg

SEQ ID NO: 689843 - DNA, 25 bp, Rattus norvegicus
tttccacaggaaagcagtagttcag

SEQ ID NO: 689844 - DNA, 25 bp, Rattus norvegicus
tttccacaggaatgcagtagttcag

SEQ ID NO: 689845 - DNA, 25 bp, Rattus norvegicus
tttccacatcgtcttgttagctttt

SEQ ID NO: 689846 - DNA, 25 bp, Rattus norvegicus
tttccacatcgtgttgttagctttt

SEQ ID NO: 689847 - DNA, 25 bp, Rattus norvegicus
tttccacatctccagaattccatag

SEQ ID NO: 689848 - DNA, 25 bp, Rattus norvegicus
tttccacatctcgagaattccatag

SEQ ID NO: 689849 - DNA, 25 bp, Rattus norvegicus
tttccacatggaatctcgccagaag

SEQ ID NO: 689850 - DNA, 25 bp, Rattus norvegicus
tttccacatggattctcgccagaag

SEQ ID NO: 689851 - DNA, 25 bp, Rattus norvegicus
tttccacattacagtacctccgagg

SEQ ID NO: 689852 - DNA, 25 bp, Rattus norvegicus
tttccacattactgtacctccgagg

SEQ ID NO: 689853 - DNA, 25 bp, Rattus norvegicus
tttccacattctagctgagctctct

SEQ ID NO: 689854 - DNA, 25 bp, Rattus norvegicus
tttccacattcttgctgagctctct

SEQ ID NO: 689855 - DNA, 25 bp, Rattus norvegicus
tttccacattggctgctacaagtgt

SEQ ID NO: 689856 - DNA, 25 bp, Rattus norvegicus
tttccacattgggtgctacaagtgt

SEQ ID NO: 689857 - DNA, 25 bp, Rattus norvegicus
tttccaccaattccagcatctgtgt

SEQ ID NO: 689858 - DNA, 25 bp, Rattus norvegicus
tttccaccaattgcagcatctgtgt

SEQ ID NO: 689859 - DNA, 25 bp, Rattus norvegicus
tttccaccacataggtcctgggaat

SEQ ID NO: 689860 - DNA, 25 bp, Rattus norvegicus
tttccaccacattggtcctgggaat

SEQ ID NO: 689861 - DNA, 25 bp, Rattus norvegicus
tttccaccacgtctggcttgaagga

SEQ ID NO: 689862 - DNA, 25 bp, Rattus norvegicus
tttccaccacgtgtggcttgaagga

SEQ ID NO: 689863 - DNA, 25 bp, Rattus norvegicus
tttccaccatcgactgtggcctggt

SEQ ID NO: 689864 - DNA, 25 bp, Rattus norvegicus
tttccaccatcgtctgtggcctggt

SEQ ID NO: 689865 - DNA, 25 bp, Rattus norvegicus
tttccaccccaacactgatgtagac

SEQ ID NO: 689866 - DNA, 25 bp, Rattus norvegicus
tttccaccccaagactgatgtagac

SEQ ID NO: 689867 - DNA, 25 bp, Rattus norvegicus
tttccaccgcagacgtatcaatgtc

SEQ ID NO: 689868 - DNA, 25 bp, Rattus norvegicus
tttccaccgcagtcgtatcaatgtc

SEQ ID NO: 689869 - DNA, 25 bp, Rattus norvegicus
tttccaccggctaacttatgagcat

SEQ ID NO: 689870 - DNA, 25 bp, Rattus norvegicus
tttccaccggcttacttatgagcat

SEQ ID NO: 689871 - DNA, 25 bp, Rattus norvegicus
tttccacctcgacagcatagctatt

SEQ ID NO: 689872 - DNA, 25 bp, Rattus norvegicus
tttccacctcgagagcatagctatt

SEQ ID NO: 689873 - DNA, 25 bp, Rattus norvegicus
tttccaccttttctctgaacatcct

SEQ ID NO: 689874 - DNA, 25 bp, Rattus norvegicus
tttccaccttttgtctgaacatcct

SEQ ID NO: 689875 - DNA, 25 bp, Rattus norvegicus
tttccacgacagatcacatcaatct

SEQ ID NO: 689876 - DNA, 25 bp, Rattus norvegicus
tttccacgacagttcacatcaatct

SEQ ID NO: 689877 - DNA, 25 bp, Rattus norvegicus
tttccacgcctgagttagtctgtac

SEQ ID NO: 689878 - DNA, 25 bp, Rattus norvegicus
tttccacgcctgtgttagtctgtac

SEQ ID NO: 689879 - DNA, 25 bp, Rattus norvegicus
tttccacgcgagaccgaagggtgtg

SEQ ID NO: 689880 - DNA, 25 bp, Rattus norvegicus
tttccacgcgagtccgaagggtgtg

SEQ ID NO: 689881 - DNA, 25 bp, Rattus norvegicus
tttccacgtagcagtcagccttatt

SEQ ID NO: 689882 - DNA, 25 bp, Rattus norvegicus
tttccacgtagctgtcagccttatt

SEQ ID NO: 689883 - DNA, 25 bp, Rattus norvegicus
tttccacgttttaaatctgcattgt

SEQ ID NO: 689884 - DNA, 25 bp, Rattus norvegicus
tttccacgtttttaatctgcattgt

SEQ ID NO: 689885 - DNA, 25 bp, Rattus norvegicus
tttccactcaggctccaaggaccaa

SEQ ID NO: 689886 - DNA, 25 bp, Rattus norvegicus
tttccactcagggtccaaggaccaa

SEQ ID NO: 689887 - DNA, 25 bp, Rattus norvegicus
tttccactccttcagcgcggtggca

SEQ ID NO: 689888 - DNA, 25 bp, Rattus norvegicus
tttccactccttgagcgcggtggca

SEQ ID NO: 689889 - DNA, 25 bp, Rattus norvegicus
tttccactctacactgtcttgagac

SEQ ID NO: 689890 - DNA, 25 bp, Rattus norvegicus
tttccactctactctgtcttgagac

SEQ ID NO: 689891 - DNA, 25 bp, Rattus norvegicus
tttccactctggatgggaccctgag

SEQ ID NO: 689892 - DNA, 25 bp, Rattus norvegicus
tttccactctggttgggaccctgag

SEQ ID NO: 689893 - DNA, 25 bp, Rattus norvegicus
tttccactgaccattgagctgtttc

SEQ ID NO: 689894 - DNA, 25 bp, Rattus norvegicus
tttccactgacctttgagctgtttc

SEQ ID NO: 689895 - DNA, 25 bp, Rattus norvegicus
tttccactgctgacatttgatttcc

SEQ ID NO: 689896 - DNA, 25 bp, Rattus norvegicus
tttccactgctgtcatttgatttcc

SEQ ID NO: 689897 - DNA, 25 bp, Rattus norvegicus
tttccactggcaactgtagaacggt

SEQ ID NO: 689898 - DNA, 25 bp, Rattus norvegicus
tttccactggcatctgtagaacggt

SEQ ID NO: 689899 - DNA, 25 bp, Rattus norvegicus
tttccactgggcacttctctcgact

SEQ ID NO: 689900 - DNA, 25 bp, Rattus norvegicus
tttccactgggctcttctctcgact

SEQ ID NO: 689901 - DNA, 25 bp, Rattus norvegicus
tttccacttgtgatttttcttacag

SEQ ID NO: 689902 - DNA, 25 bp, Rattus norvegicus
tttccacttgtgttttttcttacag

SEQ ID NO: 689903 - DNA, 25 bp, Rattus norvegicus
tttccactttttctcatcactgagg

SEQ ID NO: 689904 - DNA, 25 bp, Rattus norvegicus
tttccactttttgtcatcactgagg

SEQ ID NO: 689905 - DNA, 25 bp, Rattus norvegicus
tttccagaacacagcatccggtttg

SEQ ID NO: 689906 - DNA, 25 bp, Rattus norvegicus
tttccagaacactgcatccggtttg

SEQ ID NO: 689907 - DNA, 25 bp, Rattus norvegicus
tttccagaatggacctgttcgacgt

SEQ ID NO: 689908 - DNA, 25 bp, Rattus norvegicus
tttccagaatggtcctgttcgacgt

SEQ ID NO: 689909 - DNA, 25 bp, Rattus norvegicus
tttccagaccaacgactacatcatc

SEQ ID NO: 689910 - DNA, 25 bp, Rattus norvegicus
tttccagaccaaggactacatcatc

SEQ ID NO: 689911 - DNA, 25 bp, Rattus norvegicus
tttccagaccccacttgaacaggaa

SEQ ID NO: 689912 - DNA, 25 bp, Rattus norvegicus
tttccagacccctcttgaacaggaa

SEQ ID NO: 689913 - DNA, 25 bp, Rattus norvegicus
tttccagacgctccagtcaagttga

SEQ ID NO: 689914 - DNA, 25 bp, Rattus norvegicus
tttccagacgctgcagtcaagttga

SEQ ID NO: 689915 - DNA, 25 bp, Rattus norvegicus
tttccagactctacaggcacaaaac

SEQ ID NO: 689916 - DNA, 25 bp, Rattus norvegicus
tttccagactcttcaggcacaaaac

SEQ ID NO: 689917 - DNA, 25 bp, Rattus norvegicus
tttccagaggaacacatgtccctgt

SEQ ID NO: 689918 - DNA, 25 bp, Rattus norvegicus
tttccagaggaagacatgtccctgt

SEQ ID NO: 689919 - DNA, 25 bp, Rattus norvegicus
tttccagagggaattctataaccta

SEQ ID NO: 689920 - DNA, 25 bp, Rattus norvegicus
tttccagagggatttctataaccta

SEQ ID NO: 689921 - DNA, 25 bp, Rattus norvegicus
tttccagatcataagccacttgtgc

SEQ ID NO: 689922 - DNA, 25 bp, Rattus norvegicus
tttccagatcattagccacttgtgc

SEQ ID NO: 689923 - DNA, 25 bp, Rattus norvegicus
tttccagatcctacttctcgaggtt

SEQ ID NO: 689924 - DNA, 25 bp, Rattus norvegicus
tttccagatccttcttctcgaggtt

SEQ ID NO: 689925 - DNA, 25 bp, Rattus norvegicus
tttccagatctcagactggcctcag

SEQ ID NO: 689926 - DNA, 25 bp, Rattus norvegicus
tttccagatctctgactggcctcag

SEQ ID NO: 689927 - DNA, 25 bp, Rattus norvegicus
tttccagatgcgctgactcaacgta

SEQ ID NO: 689928 - DNA, 25 bp, Rattus norvegicus
tttccagatgcggtgactcaacgta

SEQ ID NO: 689929 - DNA, 25 bp, Rattus norvegicus
tttccagatggaataaaaaggcccg

SEQ ID NO: 689930 - DNA, 25 bp, Rattus norvegicus
tttccagatggattaaaaaggcccg

SEQ ID NO: 689931 - DNA, 25 bp, Rattus norvegicus
tttccagattttccccatccaaata

SEQ ID NO: 689932 - DNA, 25 bp, Rattus norvegicus
tttccagattttgcccatccaaata

SEQ ID NO: 689933 - DNA, 25 bp, Rattus norvegicus
tttccagcagcactgttgtaccatg

SEQ ID NO: 689934 - DNA, 25 bp, Rattus norvegicus
tttccagcagcagtgttgtaccatg

SEQ ID NO: 689935 - DNA, 25 bp, Rattus norvegicus
tttccagcaggaagctacagagaac

SEQ ID NO: 689936 - DNA, 25 bp, Rattus norvegicus
tttccagcaggatgctacagagaac

SEQ ID NO: 689937 - DNA, 25 bp, Rattus norvegicus
tttccagcaggtactagtgccttga

SEQ ID NO: 689938 - DNA, 25 bp, Rattus norvegicus
tttccagcaggttctagtgccttga

SEQ ID NO: 689939 - DNA, 25 bp, Rattus norvegicus
tttccagcattgaggtacttgcccc

SEQ ID NO: 689940 - DNA, 25 bp, Rattus norvegicus
tttccagcattgtggtacttgcccc

SEQ ID NO: 689941 - DNA, 25 bp, Rattus norvegicus
tttccagccatccactagtgctgaa

SEQ ID NO: 689942 - DNA, 25 bp, Rattus norvegicus
tttccagccatcgactagtgctgaa

SEQ ID NO: 689943 - DNA, 25 bp, Rattus norvegicus
tttccagccctccacagagaatttg

SEQ ID NO: 689944 - DNA, 25 bp, Rattus norvegicus
tttccagccctcgacagagaatttg

SEQ ID NO: 689945 - DNA, 25 bp, Rattus norvegicus
tttccagccgccatgctaggccggg

SEQ ID NO: 689946 - DNA, 25 bp, Rattus norvegicus
tttccagccgccttgctaggccggg

SEQ ID NO: 689947 - DNA, 25 bp, Rattus norvegicus
tttccagcctggaccaaaaggacag

SEQ ID NO: 689948 - DNA, 25 bp, Rattus norvegicus
tttccagcctggcagcatcacggag

SEQ ID NO: 689949 - DNA, 25 bp, Rattus norvegicus
tttccagcctgggagcatcacggag

SEQ ID NO: 689950 - DNA, 25 bp, Rattus norvegicus
tttccagcctggtccaaaaggacag

SEQ ID NO: 689951 - DNA, 25 bp, Rattus norvegicus
tttccagcgcacctgtatgtgtgtg

SEQ ID NO: 689952 - DNA, 25 bp, Rattus norvegicus
tttccagcgcacgtgtatgtgtgtg

SEQ ID NO: 689953 - DNA, 25 bp, Rattus norvegicus
tttccagctacactgttttggagca

SEQ ID NO: 689954 - DNA, 25 bp, Rattus norvegicus
tttccagctacagtgttttggagca

SEQ ID NO: 689955 - DNA, 25 bp, Rattus norvegicus
tttccagctaccctttttcaagaat

SEQ ID NO: 689956 - DNA, 25 bp, Rattus norvegicus
tttccagctaccgtttttcaagaat

SEQ ID NO: 689957 - DNA, 25 bp, Rattus norvegicus
tttccagctcccatgtttagaggca

SEQ ID NO: 689958 - DNA, 25 bp, Rattus norvegicus
tttccagctcccttgtttagaggca

SEQ ID NO: 689959 - DNA, 25 bp, Rattus norvegicus
tttccagctcggagtttgaggcaca

SEQ ID NO: 689960 - DNA, 25 bp, Rattus norvegicus
tttccagctcggtgtttgaggcaca

SEQ ID NO: 689961 - DNA, 25 bp, Rattus norvegicus
tttccagctcttaggccacggttca

SEQ ID NO: 689962 - DNA, 25 bp, Rattus norvegicus
tttccagctctttggccacggttca

SEQ ID NO: 689963 - DNA, 25 bp, Rattus norvegicus
tttccagctgtcagcttggatctaa

SEQ ID NO: 689964 - DNA, 25 bp, Rattus norvegicus
tttccagctgtctgcttggatctaa

SEQ ID NO: 689965 - DNA, 25 bp, Rattus norvegicus
tttccaggacaaccacagccatttg

SEQ ID NO: 689966 - DNA, 25 bp, Rattus norvegicus
tttccaggacaagcacagccatttg

SEQ ID NO: 689967 - DNA, 25 bp, Rattus norvegicus
tttccaggccgcagcatgggtgtgc

SEQ ID NO: 689968 - DNA, 25 bp, Rattus norvegicus
tttccaggccgctgcatgggtgtgc

SEQ ID NO: 689969 - DNA, 25 bp, Rattus norvegicus
tttccaggcgatctggtactctgac

SEQ ID NO: 689970 - DNA, 25 bp, Rattus norvegicus
tttccaggcgatgtggtactctgac

SEQ ID NO: 689971 - DNA, 25 bp, Rattus norvegicus
tttccaggcttcaccttaggtcctt

SEQ ID NO: 689972 - DNA, 25 bp, Rattus norvegicus
tttccaggcttctccttaggtcctt

SEQ ID NO: 689973 - DNA, 25 bp, Rattus norvegicus
tttccagggcaaacatgagatcgca

SEQ ID NO: 689974 - DNA, 25 bp, Rattus norvegicus
tttccagggcaatcatgagatcgca

SEQ ID NO: 689975 - DNA, 25 bp, Rattus norvegicus
tttccaggtctgcttaactttctaa

SEQ ID NO: 689976 - DNA, 25 bp, Rattus norvegicus
tttccaggtctggttaactttctaa

SEQ ID NO: 689977 - DNA, 25 bp, Rattus norvegicus
tttccagtaatcctaatttgcacga

SEQ ID NO: 689978 - DNA, 25 bp, Rattus norvegicus
tttccagtaatcgtaatttgcacga

SEQ ID NO: 689979 - DNA, 25 bp, Rattus norvegicus
tttccagtacgtcctgtgcatgggt

SEQ ID NO: 689980 - DNA, 25 bp, Rattus norvegicus
tttccagtacgtgctgtgcatgggt

SEQ ID NO: 689981 - DNA, 25 bp, Rattus norvegicus
tttccagtagtaatgttacctgctt

SEQ ID NO: 689982 - DNA, 25 bp, Rattus norvegicus
tttccagtagtattgttacctgctt

SEQ ID NO: 689983 - DNA, 25 bp, Rattus norvegicus
tttccagtagtcattctataccagg

SEQ ID NO: 689984 - DNA, 25 bp, Rattus norvegicus
tttccagtagtctttctataccagg

SEQ ID NO: 689985 - DNA, 25 bp, Rattus norvegicus
tttccagtatctcttaacccagaac

SEQ ID NO: 689986 - DNA, 25 bp, Rattus norvegicus
tttccagtatctgttaacccagaac

SEQ ID NO: 689987 - DNA, 25 bp, Rattus norvegicus
tttccagtcatgacctccataatgt

SEQ ID NO: 689988 - DNA, 25 bp, Rattus norvegicus
tttccagtcatgtcctccataatgt

SEQ ID NO: 689989 - DNA, 25 bp, Rattus norvegicus
tttccagtcccaaaaccggcacatg

SEQ ID NO: 689990 - DNA, 25 bp, Rattus norvegicus
tttccagtcccactgagcaaacggt

SEQ ID NO: 689991 - DNA, 25 bp, Rattus norvegicus
tttccagtcccagtgagcaaacggt

SEQ ID NO: 689992 - DNA, 25 bp, Rattus norvegicus
tttccagtcccataaccggcacatg

SEQ ID NO: 689993 - DNA, 25 bp, Rattus norvegicus
tttccagtctgacatctaccctata

SEQ ID NO: 689994 - DNA, 25 bp, Rattus norvegicus
tttccagtctgagatctaccctata

SEQ ID NO: 689995 - DNA, 25 bp, Rattus norvegicus
tttccagtctttactgtcaaagaaa

SEQ ID NO: 689996 - DNA, 25 bp, Rattus norvegicus
tttccagtctttagacttttggcaa

SEQ ID NO: 689997 - DNA, 25 bp, Rattus norvegicus
tttccagtcttttctgtcaaagaaa

SEQ ID NO: 689998 - DNA, 25 bp, Rattus norvegicus
tttccagtcttttgacttttggcaa

SEQ ID NO: 689999 - DNA, 25 bp, Rattus norvegicus
tttccagtgaacagacgttccgtcc

SEQ ID NO: 690000 - DNA, 25 bp, Rattus norvegicus
tttccagtgaactgacgttccgtcc

SEQ ID NO: 690001 - DNA, 25 bp, Rattus norvegicus
tttccagtgcagcatatgccagcat

SEQ ID NO: 690002 - DNA, 25 bp, Rattus norvegicus
tttccagtgcaggatatgccagcat

SEQ ID NO: 690003 - DNA, 25 bp, Rattus norvegicus
tttccagtgctccttacacaggaca

SEQ ID NO: 690004 - DNA, 25 bp, Rattus norvegicus
tttccagtgctcgttacacaggaca

SEQ ID NO: 690005 - DNA, 25 bp, Rattus norvegicus
tttccagtgcttccctgtgctctaa

SEQ ID NO: 690006 - DNA, 25 bp, Rattus norvegicus
tttccagtgcttgcctgtgctctaa

SEQ ID NO: 690007 - DNA, 25 bp, Rattus norvegicus
tttccagtgggcctagccagcttga

SEQ ID NO: 690008 - DNA, 25 bp, Rattus norvegicus
tttccagtgggcgtagccagcttga

SEQ ID NO: 690009 - DNA, 25 bp, Rattus norvegicus
tttccagtggtgatgaacttggctg

SEQ ID NO: 690010 - DNA, 25 bp, Rattus norvegicus
tttccagtggtgttgaacttggctg

SEQ ID NO: 690011 - DNA, 25 bp, Rattus norvegicus
tttccagtgtccacacatctgtgac

SEQ ID NO: 690012 - DNA, 25 bp, Rattus norvegicus
tttccagtgtcctcacatctgtgac

SEQ ID NO: 690013 - DNA, 25 bp, Rattus norvegicus
tttccagttcagctagtatacctat

SEQ ID NO: 690014 - DNA, 25 bp, Rattus norvegicus
tttccagttcaggtagtatacctat

SEQ ID NO: 690015 - DNA, 25 bp, Rattus norvegicus
tttccagttctgatcccatgttcca

SEQ ID NO: 690016 - DNA, 25 bp, Rattus norvegicus
tttccagttctgttcccatgttcca

SEQ ID NO: 690017 - DNA, 25 bp, Rattus norvegicus
tttccagttggtcacagtaggccct

SEQ ID NO: 690018 - DNA, 25 bp, Rattus norvegicus
tttccagttggtgacagtaggccct

SEQ ID NO: 690019 - DNA, 25 bp, Rattus norvegicus
tttccagtttccatcttgctttctt

SEQ ID NO: 690020 - DNA, 25 bp, Rattus norvegicus
tttccagtttccttcttgctttctt

SEQ ID NO: 690021 - DNA, 25 bp, Rattus norvegicus
tttccagtttctccactcgagcaaa

SEQ ID NO: 690022 - DNA, 25 bp, Rattus norvegicus
tttccagtttctgcactcgagcaaa

SEQ ID NO: 690023 - DNA, 25 bp, Rattus norvegicus
tttccagtttgcacagtgctttaaa

SEQ ID NO: 690024 - DNA, 25 bp, Rattus norvegicus
tttccagtttgctcagtgctttaaa

SEQ ID NO: 690025 - DNA, 25 bp, Rattus norvegicus
tttccataactgaccttgtcaccat

SEQ ID NO: 690026 - DNA, 25 bp, Rattus norvegicus
tttccataactgtccttgtcaccat

SEQ ID NO: 690027 - DNA, 25 bp, Rattus norvegicus
tttccataagttactctgtcctgtt

SEQ ID NO: 690028 - DNA, 25 bp, Rattus norvegicus
tttccataagtttctctgtcctgtt

SEQ ID NO: 690029 - DNA, 25 bp, Rattus norvegicus
tttccataccctagagccttgaaga

SEQ ID NO: 690030 - DNA, 25 bp, Rattus norvegicus
tttccatacccttgagccttgaaga

SEQ ID NO: 690031 - DNA, 25 bp, Rattus norvegicus
tttccatatctgagggagtggctat

SEQ ID NO: 690032 - DNA, 25 bp, Rattus norvegicus
tttccatatctgtgggagtggctat

SEQ ID NO: 690033 - DNA, 25 bp, Rattus norvegicus
tttccatcaataaacccacaaggtg

SEQ ID NO: 690034 - DNA, 25 bp, Rattus norvegicus
tttccatcaatatacccacaaggtg

SEQ ID NO: 690035 - DNA, 25 bp, Rattus norvegicus
tttccatcagctatacgacacggtg

SEQ ID NO: 690036 - DNA, 25 bp, Rattus norvegicus
tttccatcagctttacgacacggtg

SEQ ID NO: 690037 - DNA, 25 bp, Rattus norvegicus
tttccatcagtgctgaccgtttcta

SEQ ID NO: 690038 - DNA, 25 bp, Rattus norvegicus
tttccatcagtggtgaccgtttcta

SEQ ID NO: 690039 - DNA, 25 bp, Rattus norvegicus
tttccatcatgccttgttcctaaag

SEQ ID NO: 690040 - DNA, 25 bp, Rattus norvegicus
tttccatcatgcgttgttcctaaag

SEQ ID NO: 690041 - DNA, 25 bp, Rattus norvegicus
tttccatccagtccttttggtggca

SEQ ID NO: 690042 - DNA, 25 bp, Rattus norvegicus
tttccatccagtgcttttggtggca

SEQ ID NO: 690043 - DNA, 25 bp, Rattus norvegicus
tttccatccctccagaaagttctgt

SEQ ID NO: 690044 - DNA, 25 bp, Rattus norvegicus
tttccatccctcgagaaagttctgt

SEQ ID NO: 690045 - DNA, 25 bp, Rattus norvegicus
tttccatcctccacgctaataaaga

SEQ ID NO: 690046 - DNA, 25 bp, Rattus norvegicus
tttccatcctcctcgctaataaaga

SEQ ID NO: 690047 - DNA, 25 bp, Rattus norvegicus
tttccatctctcacacttgagacag

SEQ ID NO: 690048 - DNA, 25 bp, Rattus norvegicus
tttccatctctctcacttgagacag

SEQ ID NO: 690049 - DNA, 25 bp, Rattus norvegicus
tttccatctgaacgcacatgctgca

SEQ ID NO: 690050 - DNA, 25 bp, Rattus norvegicus
tttccatctgaaggcacatgctgca

SEQ ID NO: 690051 - DNA, 25 bp, Rattus norvegicus
tttccatctggactctacgtcgatc

SEQ ID NO: 690052 - DNA, 25 bp, Rattus norvegicus
tttccatctggagtctacgtcgatc

SEQ ID NO: 690053 - DNA, 25 bp, Rattus norvegicus
tttccatgacacctgccggcagtga

SEQ ID NO: 690054 - DNA, 25 bp, Rattus norvegicus
tttccatgacacgtgccggcagtga

SEQ ID NO: 690055 - DNA, 25 bp, Rattus norvegicus
tttccatgacggagtttcctctaaa

SEQ ID NO: 690056 - DNA, 25 bp, Rattus norvegicus
tttccatgacggtgtttcctctaaa

SEQ ID NO: 690057 - DNA, 25 bp, Rattus norvegicus
tttccatgcatgcatcttccactga

SEQ ID NO: 690058 - DNA, 25 bp, Rattus norvegicus
tttccatgcatggatcttccactga

SEQ ID NO: 690059 - DNA, 25 bp, Rattus norvegicus
tttccatggcacctctaaactgtat

SEQ ID NO: 690060 - DNA, 25 bp, Rattus norvegicus
tttccatggcacgtctaaactgtat

SEQ ID NO: 690061 - DNA, 25 bp, Rattus norvegicus
tttccatgggaaccctcgatgtcag

SEQ ID NO: 690062 - DNA, 25 bp, Rattus norvegicus
tttccatgggaagcctcgatgtcag

SEQ ID NO: 690063 - DNA, 25 bp, Rattus norvegicus
tttccatgggtacggtcggcagact

SEQ ID NO: 690064 - DNA, 25 bp, Rattus norvegicus
tttccatgggtagggtcggcagact

SEQ ID NO: 690065 - DNA, 25 bp, Rattus norvegicus
tttccatgggtgagcaagtgggcct

SEQ ID NO: 690066 - DNA, 25 bp, Rattus norvegicus
tttccatgggtgtgcaagtgggcct

SEQ ID NO: 690067 - DNA, 25 bp, Rattus norvegicus
tttccatggttgaaggtcagggtga

SEQ ID NO: 690068 - DNA, 25 bp, Rattus norvegicus
tttccatggttgtaggtcagggtga

SEQ ID NO: 690069 - DNA, 25 bp, Rattus norvegicus
tttccatgtataaactggcctcttt

SEQ ID NO: 690070 - DNA, 25 bp, Rattus norvegicus
tttccatgtatatactggcctcttt

SEQ ID NO: 690071 - DNA, 25 bp, Rattus norvegicus
tttccatgtcttcccttcttaacaa

SEQ ID NO: 690072 - DNA, 25 bp, Rattus norvegicus
tttccatgtcttgccttcttaacaa

SEQ ID NO: 690073 - DNA, 25 bp, Rattus norvegicus
tttccatgtgcacaacagtgccggc

SEQ ID NO: 690074 - DNA, 25 bp, Rattus norvegicus
tttccatgtgcagaacagtgccggc

SEQ ID NO: 690075 - DNA, 25 bp, Rattus norvegicus
tttccatgtgtaaacgcttgccgac

SEQ ID NO: 690076 - DNA, 25 bp, Rattus norvegicus
tttccatgtgtatacgcttgccgac

SEQ ID NO: 690077 - DNA, 25 bp, Rattus norvegicus
tttccatgttgcaagatcctgtcag

SEQ ID NO: 690078 - DNA, 25 bp, Rattus norvegicus
tttccatgttgctagatcctgtcag

SEQ ID NO: 690079 - DNA, 25 bp, Rattus norvegicus
tttccattactgcaactagacctag

SEQ ID NO: 690080 - DNA, 25 bp, Rattus norvegicus
tttccattactggaactagacctag

SEQ ID NO: 690081 - DNA, 25 bp, Rattus norvegicus
tttccattcactattctgttacctg

SEQ ID NO: 690082 - DNA, 25 bp, Rattus norvegicus
tttccattcacttttctgttacctg

SEQ ID NO: 690083 - DNA, 25 bp, Rattus norvegicus
tttccattcattacttttttagtca

SEQ ID NO: 690084 - DNA, 25 bp, Rattus norvegicus
tttccattcattctattcttctgtt

SEQ ID NO: 690085 - DNA, 25 bp, Rattus norvegicus
tttccattcattgtattcttctgtt

SEQ ID NO: 690086 - DNA, 25 bp, Rattus norvegicus
tttccattcatttcttttttagtca

SEQ ID NO: 690087 - DNA, 25 bp, Rattus norvegicus
tttccattcctacctgtgacataca

SEQ ID NO: 690088 - DNA, 25 bp, Rattus norvegicus
tttccattcctagctgtgacataca

SEQ ID NO: 690089 - DNA, 25 bp, Rattus norvegicus
tttccattctagcagagaacccttg

SEQ ID NO: 690090 - DNA, 25 bp, Rattus norvegicus
tttccattctaggagagaacccttg

SEQ ID NO: 690091 - DNA, 25 bp, Rattus norvegicus
tttccattcttgacttggctactgc

SEQ ID NO: 690092 - DNA, 25 bp, Rattus norvegicus
tttccattcttgtcttggctactgc

SEQ ID NO: 690093 - DNA, 25 bp, Rattus norvegicus
tttccattgctcagacttgggagtc

SEQ ID NO: 690094 - DNA, 25 bp, Rattus norvegicus
tttccattgctctgacttgggagtc

SEQ ID NO: 690095 - DNA, 25 bp, Rattus norvegicus
tttccattgcttaccagcatttcag

SEQ ID NO: 690096 - DNA, 25 bp, Rattus norvegicus
tttccattgctttccagcatttcag

SEQ ID NO: 690097 - DNA, 25 bp, Rattus norvegicus
tttccattgtggacatcagggtgct

SEQ ID NO: 690098 - DNA, 25 bp, Rattus norvegicus
tttccattgtggtcatcagggtgct

SEQ ID NO: 690099 - DNA, 25 bp, Rattus norvegicus
tttccatttaatccatctgctctga

SEQ ID NO: 690100 - DNA, 25 bp, Rattus norvegicus
tttccatttaatgcatctgctctga

SEQ ID NO: 690101 - DNA, 25 bp, Rattus norvegicus
tttccatttcacaagctacagctgc

SEQ ID NO: 690102 - DNA, 25 bp, Rattus norvegicus
tttccatttcacatataccacatag

SEQ ID NO: 690103 - DNA, 25 bp, Rattus norvegicus
tttccatttcactagctacagctgc

SEQ ID NO: 690104 - DNA, 25 bp, Rattus norvegicus
tttccatttcacttataccacatag

SEQ ID NO: 690105 - DNA, 25 bp, Rattus norvegicus
tttccatttctaaacacttttactg

SEQ ID NO: 690106 - DNA, 25 bp, Rattus norvegicus
tttccatttctatacacttttactg

SEQ ID NO: 690107 - DNA, 25 bp, Rattus norvegicus
tttccatttgagaaccctacttcca

SEQ ID NO: 690108 - DNA, 25 bp, Rattus norvegicus
tttccatttgagtaccctacttcca

SEQ ID NO: 690109 - DNA, 25 bp, Rattus norvegicus
tttccattttttaatattattgctt

SEQ ID NO: 690110 - DNA, 25 bp, Rattus norvegicus
tttccattttttccctcagattcct

SEQ ID NO: 690111 - DNA, 25 bp, Rattus norvegicus
tttccattttttgcctcagattcct

SEQ ID NO: 690112 - DNA, 25 bp, Rattus norvegicus
tttccatttttttatattattgctt

SEQ ID NO: 690113 - DNA, 25 bp, Rattus norvegicus
tttcccaaacaacagtctagctggt

SEQ ID NO: 690114 - DNA, 25 bp, Rattus norvegicus
tttcccaaacaagagtctagctggt

SEQ ID NO: 690115 - DNA, 25 bp, Rattus norvegicus
tttcccaaacttactctcagaaggc

SEQ ID NO: 690116 - DNA, 25 bp, Rattus norvegicus
tttcccaaactttctctcagaaggc

SEQ ID NO: 690117 - DNA, 25 bp, Rattus norvegicus
tttcccaaagatcattcaacagagt

SEQ ID NO: 690118 - DNA, 25 bp, Rattus norvegicus
tttcccaaagatgattcaacagagt

SEQ ID NO: 690119 - DNA, 25 bp, Rattus norvegicus
tttcccaacaagctcattcggctgt

SEQ ID NO: 690120 - DNA, 25 bp, Rattus norvegicus
tttcccaacaaggtcattcggctgt

SEQ ID NO: 690121 - DNA, 25 bp, Rattus norvegicus
tttcccaagagaagccctgtgtgtt

SEQ ID NO: 690122 - DNA, 25 bp, Rattus norvegicus
tttcccaagagatgccctgtgtgtt

SEQ ID NO: 690123 - DNA, 25 bp, Rattus norvegicus
tttcccaagagtatcagcagcgaca

SEQ ID NO: 690124 - DNA, 25 bp, Rattus norvegicus
tttcccaagagtttcagcagcgaca

SEQ ID NO: 690125 - DNA, 25 bp, Rattus norvegicus
tttcccaaggccaatgtctggagga

SEQ ID NO: 690126 - DNA, 25 bp, Rattus norvegicus
tttcccaaggcctatgtctggagga

SEQ ID NO: 690127 - DNA, 25 bp, Rattus norvegicus
tttcccaagtggcattttcatctca

SEQ ID NO: 690128 - DNA, 25 bp, Rattus norvegicus
tttcccaagtgggattttcatctca

SEQ ID NO: 690129 - DNA, 25 bp, Rattus norvegicus
tttcccacaaccataggccataagt

SEQ ID NO: 690130 - DNA, 25 bp, Rattus norvegicus
tttcccacaaccttaggccataagt

SEQ ID NO: 690131 - DNA, 25 bp, Rattus norvegicus
tttcccacaagaatcctcatgtcag

SEQ ID NO: 690132 - DNA, 25 bp, Rattus norvegicus
tttcccacaagattcctcatgtcag

SEQ ID NO: 690133 - DNA, 25 bp, Rattus norvegicus
tttcccacacagcttcaaatgagtt

SEQ ID NO: 690134 - DNA, 25 bp, Rattus norvegicus
tttcccacacaggttcaaatgagtt

SEQ ID NO: 690135 - DNA, 25 bp, Rattus norvegicus
tttcccacactcaaaaagtcggcag

SEQ ID NO: 690136 - DNA, 25 bp, Rattus norvegicus
tttcccacactctaaaagtcggcag

SEQ ID NO: 690137 - DNA, 25 bp, Rattus norvegicus
tttcccaccagtaaagccatgtaat

SEQ ID NO: 690138 - DNA, 25 bp, Rattus norvegicus
tttcccaccagttaagccatgtaat

SEQ ID NO: 690139 - DNA, 25 bp, Rattus norvegicus
tttcccaccattattacttgcacag

SEQ ID NO: 690140 - DNA, 25 bp, Rattus norvegicus
tttcccaccatttttacttgcacag

SEQ ID NO: 690141 - DNA, 25 bp, Rattus norvegicus
tttcccacccaaacctaatattttg

SEQ ID NO: 690142 - DNA, 25 bp, Rattus norvegicus
tttcccacccaatcctaatattttg

SEQ ID NO: 690143 - DNA, 25 bp, Rattus norvegicus
tttcccacccagagctaataacagc

SEQ ID NO: 690144 - DNA, 25 bp, Rattus norvegicus
tttcccacccagtgctaataacagc

SEQ ID NO: 690145 - DNA, 25 bp, Rattus norvegicus
tttcccacccggacataaagatgtt

SEQ ID NO: 690146 - DNA, 25 bp, Rattus norvegicus
tttcccacccggtcataaagatgtt

SEQ ID NO: 690147 - DNA, 25 bp, Rattus norvegicus
tttcccacccttagactgagacaag

SEQ ID NO: 690148 - DNA, 25 bp, Rattus norvegicus
tttcccaccctttgactgagacaag

SEQ ID NO: 690149 - DNA, 25 bp, Rattus norvegicus
tttcccaccgacatcctggaggaga

SEQ ID NO: 690150 - DNA, 25 bp, Rattus norvegicus
tttcccaccgacttcctggaggaga

SEQ ID NO: 690151 - DNA, 25 bp, Rattus norvegicus
tttcccaccgagcagtcaatgtaga

SEQ ID NO: 690152 - DNA, 25 bp, Rattus norvegicus
tttcccaccgaggagtcaatgtaga

SEQ ID NO: 690153 - DNA, 25 bp, Rattus norvegicus
tttcccaccttcaaaactgtgactg

SEQ ID NO: 690154 - DNA, 25 bp, Rattus norvegicus
tttcccaccttcaaacttacaatgt

SEQ ID NO: 690155 - DNA, 25 bp, Rattus norvegicus
tttcccaccttctaaactgtgactg

SEQ ID NO: 690156 - DNA, 25 bp, Rattus norvegicus
tttcccaccttctaacttacaatgt

SEQ ID NO: 690157 - DNA, 25 bp, Rattus norvegicus
tttcccacgatcatgccatttggag

SEQ ID NO: 690158 - DNA, 25 bp, Rattus norvegicus
tttcccacgatcttgccatttggag

SEQ ID NO: 690159 - DNA, 25 bp, Rattus norvegicus
tttcccactaccaccttgggtggtg

SEQ ID NO: 690160 - DNA, 25 bp, Rattus norvegicus
tttcccactacctccttgggtggtg

SEQ ID NO: 690161 - DNA, 25 bp, Rattus norvegicus
tttcccactgatatctttgctgaca

SEQ ID NO: 690162 - DNA, 25 bp, Rattus norvegicus
tttcccactgatttctttgctgaca

SEQ ID NO: 690163 - DNA, 25 bp, Rattus norvegicus
tttcccactgcaccaatattactgg

SEQ ID NO: 690164 - DNA, 25 bp, Rattus norvegicus
tttcccactgcagcaatattactgg

SEQ ID NO: 690165 - DNA, 25 bp, Rattus norvegicus
tttcccacttatatgcccattaaca

SEQ ID NO: 690166 - DNA, 25 bp, Rattus norvegicus
tttcccacttatttgcccattaaca

SEQ ID NO: 690167 - DNA, 25 bp, Rattus norvegicus
tttcccagaagtccgcatagcgggc

SEQ ID NO: 690168 - DNA, 25 bp, Rattus norvegicus
tttcccagaagtgcgcatagcgggc

SEQ ID NO: 690169 - DNA, 25 bp, Rattus norvegicus
tttcccagagtccattgccaggcgt

SEQ ID NO: 690170 - DNA, 25 bp, Rattus norvegicus
tttcccagagtcgattgccaggcgt

SEQ ID NO: 690171 - DNA, 25 bp, Rattus norvegicus
tttcccagagtgctccgcgccgtga

SEQ ID NO: 690172 - DNA, 25 bp, Rattus norvegicus
tttcccagagtggtccgcgccgtga

SEQ ID NO: 690173 - DNA, 25 bp, Rattus norvegicus
tttcccagcaatcttttaccctttg

SEQ ID NO: 690174 - DNA, 25 bp, Rattus norvegicus
tttcccagcaatgttttaccctttg

SEQ ID NO: 690175 - DNA, 25 bp, Rattus norvegicus
tttcccagcaccctgggttcaaagc

SEQ ID NO: 690176 - DNA, 25 bp, Rattus norvegicus
tttcccagcaccgtgggttcaaagc

SEQ ID NO: 690177 - DNA, 25 bp, Rattus norvegicus
tttcccagctccctggaaagtagaa

SEQ ID NO: 690178 - DNA, 25 bp, Rattus norvegicus
tttcccagctccgtggaaagtagaa

SEQ ID NO: 690179 - DNA, 25 bp, Rattus norvegicus
tttcccagctggagtcaaatttaaa

SEQ ID NO: 690180 - DNA, 25 bp, Rattus norvegicus
tttcccagctggtgtcaaatttaaa

SEQ ID NO: 690181 - DNA, 25 bp, Rattus norvegicus
tttcccaggagcacttacatagtct

SEQ ID NO: 690182 - DNA, 25 bp, Rattus norvegicus
tttcccaggagctcttacatagtct

SEQ ID NO: 690183 - DNA, 25 bp, Rattus norvegicus
tttcccaggcctaagcaacagtcag

SEQ ID NO: 690184 - DNA, 25 bp, Rattus norvegicus
tttcccaggccttagcaacagtcag

SEQ ID NO: 690185 - DNA, 25 bp, Rattus norvegicus
tttcccagggcccaacatagaattg

SEQ ID NO: 690186 - DNA, 25 bp, Rattus norvegicus
tttcccagggccgaacatagaattg

SEQ ID NO: 690187 - DNA, 25 bp, Rattus norvegicus
tttcccagggttcttagtgtcccag

SEQ ID NO: 690188 - DNA, 25 bp, Rattus norvegicus
tttcccagggttgttagtgtcccag

SEQ ID NO: 690189 - DNA, 25 bp, Rattus norvegicus
tttcccaggtacatgctttaccgag

SEQ ID NO: 690190 - DNA, 25 bp, Rattus norvegicus
tttcccaggtacttgctttaccgag

SEQ ID NO: 690191 - DNA, 25 bp, Rattus norvegicus
tttcccagtatccatacccaggctt

SEQ ID NO: 690192 - DNA, 25 bp, Rattus norvegicus
tttcccagtatcgatacccaggctt

SEQ ID NO: 690193 - DNA, 25 bp, Rattus norvegicus
tttcccagtgtccatctggactatt

SEQ ID NO: 690194 - DNA, 25 bp, Rattus norvegicus
tttcccagtgtcgatctggactatt

SEQ ID NO: 690195 - DNA, 25 bp, Rattus norvegicus
tttcccataaaaaggtacagtacat

SEQ ID NO: 690196 - DNA, 25 bp, Rattus norvegicus
tttcccataaaatggtacagtacat

SEQ ID NO: 690197 - DNA, 25 bp, Rattus norvegicus
tttcccatacagagcatgccgggct

SEQ ID NO: 690198 - DNA, 25 bp, Rattus norvegicus
tttcccatacagtgcatgccgggct

SEQ ID NO: 690199 - DNA, 25 bp, Rattus norvegicus
tttcccatatgaactttatttcccc

SEQ ID NO: 690200 - DNA, 25 bp, Rattus norvegicus
tttcccatatgatctttatttcccc

SEQ ID NO: 690201 - DNA, 25 bp, Rattus norvegicus
tttcccatcagtccggcaggagaag

SEQ ID NO: 690202 - DNA, 25 bp, Rattus norvegicus
tttcccatcagtgcggcaggagaag

SEQ ID NO: 690203 - DNA, 25 bp, Rattus norvegicus
tttcccatcctacttctccctatgc

SEQ ID NO: 690204 - DNA, 25 bp, Rattus norvegicus
tttcccatcctagttctccctatgc

SEQ ID NO: 690205 - DNA, 25 bp, Rattus norvegicus
tttcccatccttaatgcattccctt

SEQ ID NO: 690206 - DNA, 25 bp, Rattus norvegicus
tttcccatccttccttaaggcgaag

SEQ ID NO: 690207 - DNA, 25 bp, Rattus norvegicus
tttcccatccttgcttaaggcgaag

SEQ ID NO: 690208 - DNA, 25 bp, Rattus norvegicus
tttcccatcctttatgcattccctt

SEQ ID NO: 690209 - DNA, 25 bp, Rattus norvegicus
tttcccatcgttcagttatgccaga

SEQ ID NO: 690210 - DNA, 25 bp, Rattus norvegicus
tttcccatcgttgagttatgccaga

SEQ ID NO: 690211 - DNA, 25 bp, Rattus norvegicus
tttcccatctgccaacattcaagaa

SEQ ID NO: 690212 - DNA, 25 bp, Rattus norvegicus
tttcccatctgcgaacattcaagaa

SEQ ID NO: 690213 - DNA, 25 bp, Rattus norvegicus
tttcccatctttccctctgaaattt

SEQ ID NO: 690214 - DNA, 25 bp, Rattus norvegicus
tttcccatctttgcctctgaaattt

SEQ ID NO: 690215 - DNA, 25 bp, Rattus norvegicus
tttcccatgacaatacttcaatatg

SEQ ID NO: 690216 - DNA, 25 bp, Rattus norvegicus
tttcccatgacattacttcaatatg

SEQ ID NO: 690217 - DNA, 25 bp, Rattus norvegicus
tttcccatgggtcacaggctctaca

SEQ ID NO: 690218 - DNA, 25 bp, Rattus norvegicus
tttcccatgggtgacaggctctaca

SEQ ID NO: 690219 - DNA, 25 bp, Rattus norvegicus
tttcccatgtgtagcactgtccact

SEQ ID NO: 690220 - DNA, 25 bp, Rattus norvegicus
tttcccatgtgtcctttgcttgccc

SEQ ID NO: 690221 - DNA, 25 bp, Rattus norvegicus
tttcccatgtgtgctttgcttgccc

SEQ ID NO: 690222 - DNA, 25 bp, Rattus norvegicus
tttcccatgtgttgcactgtccact

SEQ ID NO: 690223 - DNA, 25 bp, Rattus norvegicus
tttcccattctccttcttcagtgct

SEQ ID NO: 690224 - DNA, 25 bp, Rattus norvegicus
tttcccattctcgttcttcagtgct

SEQ ID NO: 690225 - DNA, 25 bp, Rattus norvegicus
tttcccattgcacgacaggcaggcg

SEQ ID NO: 690226 - DNA, 25 bp, Rattus norvegicus
tttcccattgcaggacaggcaggcg

SEQ ID NO: 690227 - DNA, 25 bp, Rattus norvegicus
tttcccatttctctcctggtataat

SEQ ID NO: 690228 - DNA, 25 bp, Rattus norvegicus
tttcccatttctgtcctggtataat

SEQ ID NO: 690229 - DNA, 25 bp, Rattus norvegicus
tttcccatttgcaggctatgtaatt

SEQ ID NO: 690230 - DNA, 25 bp, Rattus norvegicus
tttcccatttgcagtcttctgtgag

SEQ ID NO: 690231 - DNA, 25 bp, Rattus norvegicus
tttcccatttgctggctatgtaatt

SEQ ID NO: 690232 - DNA, 25 bp, Rattus norvegicus
tttcccatttgctgtcttctgtgag

SEQ ID NO: 690233 - DNA, 25 bp, Rattus norvegicus
tttcccatttggaaaacgtgcatgt

SEQ ID NO: 690234 - DNA, 25 bp, Rattus norvegicus
tttcccatttggtaaacgtgcatgt

SEQ ID NO: 690235 - DNA, 25 bp, Rattus norvegicus
tttcccattttcatttcttgtaaag

SEQ ID NO: 690236 - DNA, 25 bp, Rattus norvegicus
tttcccattttcttttcttgtaaag

SEQ ID NO: 690237 - DNA, 25 bp, Rattus norvegicus
tttccccaaagcacaagataaagtc

SEQ ID NO: 690238 - DNA, 25 bp, Rattus norvegicus
tttccccaaagctcaagataaagtc

SEQ ID NO: 690239 - DNA, 25 bp, Rattus norvegicus
tttccccaaaggcatgcagtcacaa

SEQ ID NO: 690240 - DNA, 25 bp, Rattus norvegicus
tttccccaaagggatgcagtcacaa

SEQ ID NO: 690241 - DNA, 25 bp, Rattus norvegicus
tttccccaaatcctacctggagaat

SEQ ID NO: 690242 - DNA, 25 bp, Rattus norvegicus
tttccccaaatcgtacctggagaat

SEQ ID NO: 690243 - DNA, 25 bp, Rattus norvegicus
tttccccaactcatgtgaaggctct

SEQ ID NO: 690244 - DNA, 25 bp, Rattus norvegicus
tttccccaactcttgtgaaggctct

SEQ ID NO: 690245 - DNA, 25 bp, Rattus norvegicus
tttccccaagagaggcctcggtagc

SEQ ID NO: 690246 - DNA, 25 bp, Rattus norvegicus
tttccccaagagtggcctcggtagc

SEQ ID NO: 690247 - DNA, 25 bp, Rattus norvegicus
tttccccaccagatcttttaatgta

SEQ ID NO: 690248 - DNA, 25 bp, Rattus norvegicus
tttccccaccagttcttttaatgta

SEQ ID NO: 690249 - DNA, 25 bp, Rattus norvegicus
tttccccacccaacagagaagtatg

SEQ ID NO: 690250 - DNA, 25 bp, Rattus norvegicus
tttccccacccatcagagaagtatg

SEQ ID NO: 690251 - DNA, 25 bp, Rattus norvegicus
tttccccacctacagcctgtgaggg

SEQ ID NO: 690252 - DNA, 25 bp, Rattus norvegicus
tttccccacctagagcctgtgaggg

SEQ ID NO: 690253 - DNA, 25 bp, Rattus norvegicus
tttccccacggtcagcacaacgacc

SEQ ID NO: 690254 - DNA, 25 bp, Rattus norvegicus
tttccccacggtgagcacaacgacc

SEQ ID NO: 690255 - DNA, 25 bp, Rattus norvegicus
tttccccacgtgcacattacaggaa

SEQ ID NO: 690256 - DNA, 25 bp, Rattus norvegicus
tttccccacgtggacattacaggaa

SEQ ID NO: 690257 - DNA, 25 bp, Rattus norvegicus
tttccccactatcgaaacaggcgaa

SEQ ID NO: 690258 - DNA, 25 bp, Rattus norvegicus
tttccccactatggaaacaggcgaa

SEQ ID NO: 690259 - DNA, 25 bp, Rattus norvegicus
tttccccacttgactgggtaaccat

SEQ ID NO: 690260 - DNA, 25 bp, Rattus norvegicus
tttccccacttgtctgggtaaccat

SEQ ID NO: 690261 - DNA, 25 bp, Rattus norvegicus
tttccccagctacggttcagttgtc

SEQ ID NO: 690262 - DNA, 25 bp, Rattus norvegicus
tttccccagctagggttcagttgtc

SEQ ID NO: 690263 - DNA, 25 bp, Rattus norvegicus
tttccccaggaacaatcagctcaga

SEQ ID NO: 690264 - DNA, 25 bp, Rattus norvegicus
tttccccaggaagaatcagctcaga

SEQ ID NO: 690265 - DNA, 25 bp, Rattus norvegicus
tttccccagggcattcactgtgatt

SEQ ID NO: 690266 - DNA, 25 bp, Rattus norvegicus
tttccccagggctttcactgtgatt

SEQ ID NO: 690267 - DNA, 25 bp, Rattus norvegicus
tttccccagggtacccagaaagatg

SEQ ID NO: 690268 - DNA, 25 bp, Rattus norvegicus
tttccccagggttcccagaaagatg

SEQ ID NO: 690269 - DNA, 25 bp, Rattus norvegicus
tttccccaggtcaaacatcacagaa

SEQ ID NO: 690270 - DNA, 25 bp, Rattus norvegicus
tttccccaggtctaacatcacagaa

SEQ ID NO: 690271 - DNA, 25 bp, Rattus norvegicus
tttccccagtctcattcgccaggaa

SEQ ID NO: 690272 - DNA, 25 bp, Rattus norvegicus
tttccccagtctgattcgccaggaa

SEQ ID NO: 690273 - DNA, 25 bp, Rattus norvegicus
tttccccagtgcacttttagaagct

SEQ ID NO: 690274 - DNA, 25 bp, Rattus norvegicus
tttccccagtgctcttttagaagct

SEQ ID NO: 690275 - DNA, 25 bp, Rattus norvegicus
tttccccatctacggctggtagatt

SEQ ID NO: 690276 - DNA, 25 bp, Rattus norvegicus
tttccccatctagggctggtagatt

SEQ ID NO: 690277 - DNA, 25 bp, Rattus norvegicus
tttccccgagtcctgatgtcaagag

SEQ ID NO: 690278 - DNA, 25 bp, Rattus norvegicus
tttccccgagtcgtgatgtcaagag

SEQ ID NO: 690279 - DNA, 25 bp, Rattus norvegicus
tttccccgcagaattttgttcttgg

SEQ ID NO: 690280 - DNA, 25 bp, Rattus norvegicus
tttccccgcagatttttgttcttgg

SEQ ID NO: 690281 - DNA, 25 bp, Rattus norvegicus
tttccccgtgtaccctaggatgaag

SEQ ID NO: 690282 - DNA, 25 bp, Rattus norvegicus
tttccccgtgtagcctaggatgaag

SEQ ID NO: 690283 - DNA, 25 bp, Rattus norvegicus
tttcccctaagaataatttctatca

SEQ ID NO: 690284 - DNA, 25 bp, Rattus norvegicus
tttcccctaagattaatttctatca

SEQ ID NO: 690285 - DNA, 25 bp, Rattus norvegicus
tttcccctcatgctccgaggaagga

SEQ ID NO: 690286 - DNA, 25 bp, Rattus norvegicus
tttcccctcatggtccgaggaagga

SEQ ID NO: 690287 - DNA, 25 bp, Rattus norvegicus
tttcccctccaactagcaagtgtca

SEQ ID NO: 690288 - DNA, 25 bp, Rattus norvegicus
tttcccctccaagtagcaagtgtca

SEQ ID NO: 690289 - DNA, 25 bp, Rattus norvegicus
tttcccctctgtaagtgttttggag

SEQ ID NO: 690290 - DNA, 25 bp, Rattus norvegicus
tttcccctctgttagtgttttggag

SEQ ID NO: 690291 - DNA, 25 bp, Rattus norvegicus
tttcccctcttcctgtgtaagatgt

SEQ ID NO: 690292 - DNA, 25 bp, Rattus norvegicus
tttcccctcttcgtgtgtaagatgt

SEQ ID NO: 690293 - DNA, 25 bp, Rattus norvegicus
tttcccctggttagatctgactact

SEQ ID NO: 690294 - DNA, 25 bp, Rattus norvegicus
tttcccctggtttgatctgactact

SEQ ID NO: 690295 - DNA, 25 bp, Rattus norvegicus
tttcccctgtccatggtatgcactt

SEQ ID NO: 690296 - DNA, 25 bp, Rattus norvegicus
tttcccctgtccttggtatgcactt

SEQ ID NO: 690297 - DNA, 25 bp, Rattus norvegicus
tttcccctgttgacttcataaaagt

SEQ ID NO: 690298 - DNA, 25 bp, Rattus norvegicus
tttcccctgttgtcttcataaaagt

SEQ ID NO: 690299 - DNA, 25 bp, Rattus norvegicus
tttccccttaggaacacaacagcag

SEQ ID NO: 690300 - DNA, 25 bp, Rattus norvegicus
tttccccttaggactgtctagaatc

SEQ ID NO: 690301 - DNA, 25 bp, Rattus norvegicus
tttccccttaggcatagttagtctt

SEQ ID NO: 690302 - DNA, 25 bp, Rattus norvegicus
tttccccttagggatagttagtctt

SEQ ID NO: 690303 - DNA, 25 bp, Rattus norvegicus
tttccccttaggtacacaacagcag

SEQ ID NO: 690304 - DNA, 25 bp, Rattus norvegicus
tttccccttaggtctgtctagaatc

SEQ ID NO: 690305 - DNA, 25 bp, Rattus norvegicus
tttccccttcaaattcatgctgtgt

SEQ ID NO: 690306 - DNA, 25 bp, Rattus norvegicus
tttccccttcaatttcatgctgtgt

SEQ ID NO: 690307 - DNA, 25 bp, Rattus norvegicus
tttccccttgaaatagcatattaca

SEQ ID NO: 690308 - DNA, 25 bp, Rattus norvegicus
tttccccttgaattagcatattaca

SEQ ID NO: 690309 - DNA, 25 bp, Rattus norvegicus
tttccccttgtgagtcaacacacag

SEQ ID NO: 690310 - DNA, 25 bp, Rattus norvegicus
tttccccttgtgtgtcaacacacag

SEQ ID NO: 690311 - DNA, 25 bp, Rattus norvegicus
tttccccttgttatttggctactgg

SEQ ID NO: 690312 - DNA, 25 bp, Rattus norvegicus
tttccccttgttttttggctactgg

SEQ ID NO: 690313 - DNA, 25 bp, Rattus norvegicus
tttcccctttaaataacacaagcat

SEQ ID NO: 690314 - DNA, 25 bp, Rattus norvegicus
tttcccctttaattaacacaagcat

SEQ ID NO: 690315 - DNA, 25 bp, Rattus norvegicus
tttcccctttccctggaatgtgtcg

SEQ ID NO: 690316 - DNA, 25 bp, Rattus norvegicus
tttcccctttccgtggaatgtgtcg

SEQ ID NO: 690317 - DNA, 25 bp, Rattus norvegicus
tttcccctttgccaccgtggatgca

SEQ ID NO: 690318 - DNA, 25 bp, Rattus norvegicus
tttcccctttgcgaccgtggatgca

SEQ ID NO: 690319 - DNA, 25 bp, Rattus norvegicus
tttccccttttacctattaacgcat

SEQ ID NO: 690320 - DNA, 25 bp, Rattus norvegicus
tttccccttttagctattaacgcat

SEQ ID NO: 690321 - DNA, 25 bp, Rattus norvegicus
tttcccctttttagatgcaaaaatg

SEQ ID NO: 690322 - DNA, 25 bp, Rattus norvegicus
tttccccttttttgatgcaaaaatg

SEQ ID NO: 690323 - DNA, 25 bp, Rattus norvegicus
tttcccgaaattacctgggctcttg

SEQ ID NO: 690324 - DNA, 25 bp, Rattus norvegicus
tttcccgaaatttcctgggctcttg

SEQ ID NO: 690325 - DNA, 25 bp, Rattus norvegicus
tttcccgaataacatataaaatgat

SEQ ID NO: 690326 - DNA, 25 bp, Rattus norvegicus
tttcccgaataagatataaaatgat

SEQ ID NO: 690327 - DNA, 25 bp, Rattus norvegicus
tttcccgacttcaacgattcagagg

SEQ ID NO: 690328 - DNA, 25 bp, Rattus norvegicus
tttcccgacttctacgattcagagg

SEQ ID NO: 690329 - DNA, 25 bp, Rattus norvegicus
tttcccgagaagaatggagctccct

SEQ ID NO: 690330 - DNA, 25 bp, Rattus norvegicus
tttcccgagaagtatggagctccct

SEQ ID NO: 690331 - DNA, 25 bp, Rattus norvegicus
tttcccgcagacattggttagcagc

SEQ ID NO: 690332 - DNA, 25 bp, Rattus norvegicus
tttcccgcagactttggttagcagc

SEQ ID NO: 690333 - DNA, 25 bp, Rattus norvegicus
tttcccgcagtgagtctcgtggttg

SEQ ID NO: 690334 - DNA, 25 bp, Rattus norvegicus
tttcccgcagtgtgtctcgtggttg

SEQ ID NO: 690335 - DNA, 25 bp, Rattus norvegicus
tttcccgcggtccacaagtgtgaag

SEQ ID NO: 690336 - DNA, 25 bp, Rattus norvegicus
tttcccgcggtcgacaagtgtgaag

SEQ ID NO: 690337 - DNA, 25 bp, Rattus norvegicus
tttcccgctgagcattcttacaagg

SEQ ID NO: 690338 - DNA, 25 bp, Rattus norvegicus
tttcccgctgaggattcttacaagg

SEQ ID NO: 690339 - DNA, 25 bp, Rattus norvegicus
tttcccggcttgcttacaattctgg

SEQ ID NO: 690340 - DNA, 25 bp, Rattus norvegicus
tttcccggcttggttacaattctgg

SEQ ID NO: 690341 - DNA, 25 bp, Rattus norvegicus
tttcccgggaaacctggcatggcac

SEQ ID NO: 690342 - DNA, 25 bp, Rattus norvegicus
tttcccgggaaagctggcatggcac

SEQ ID NO: 690343 - DNA, 25 bp, Rattus norvegicus
tttcccgggagcaggcctgtctgtc

SEQ ID NO: 690344 - DNA, 25 bp, Rattus norvegicus
tttcccgggagctggcctgtctgtc

SEQ ID NO: 690345 - DNA, 25 bp, Rattus norvegicus
tttcccgggattccaacagccaagt

SEQ ID NO: 690346 - DNA, 25 bp, Rattus norvegicus
tttcccgggattgcaacagccaagt

SEQ ID NO: 690347 - DNA, 25 bp, Rattus norvegicus
tttcccgtccagcttgttgaacaag

SEQ ID NO: 690348 - DNA, 25 bp, Rattus norvegicus
tttcccgtccaggttgttgaacaag

SEQ ID NO: 690349 - DNA, 25 bp, Rattus norvegicus
tttcccgtgtgtctaacacacttta

SEQ ID NO: 690350 - DNA, 25 bp, Rattus norvegicus
tttcccgtgtgtgtaacacacttta

SEQ ID NO: 690351 - DNA, 25 bp, Rattus norvegicus
tttcccgttcttattcgaatgccat

SEQ ID NO: 690352 - DNA, 25 bp, Rattus norvegicus
tttcccgttctttttcgaatgccat

SEQ ID NO: 690353 - DNA, 25 bp, Rattus norvegicus
tttccctaactcatctcatttttgc

SEQ ID NO: 690354 - DNA, 25 bp, Rattus norvegicus
tttccctaactcttctcatttttgc

SEQ ID NO: 690355 - DNA, 25 bp, Rattus norvegicus
tttccctaccctcaatagccaaaag

SEQ ID NO: 690356 - DNA, 25 bp, Rattus norvegicus
tttccctaccctgaatagccaaaag

SEQ ID NO: 690357 - DNA, 25 bp, Rattus norvegicus
tttccctagagaccttaagacccag

SEQ ID NO: 690358 - DNA, 25 bp, Rattus norvegicus
tttccctagagagcttaagacccag

SEQ ID NO: 690359 - DNA, 25 bp, Rattus norvegicus
tttccctatcacctttacttcaagg

SEQ ID NO: 690360 - DNA, 25 bp, Rattus norvegicus
tttccctatcacgtttacttcaagg

SEQ ID NO: 690361 - DNA, 25 bp, Rattus norvegicus
tttccctattagatgccagtggcgc

SEQ ID NO: 690362 - DNA, 25 bp, Rattus norvegicus
tttccctattagttgccagtggcgc

SEQ ID NO: 690363 - DNA, 25 bp, Rattus norvegicus
tttccctcaaagacggtagctcagt

SEQ ID NO: 690364 - DNA, 25 bp, Rattus norvegicus
tttccctcaaagtcggtagctcagt

SEQ ID NO: 690365 - DNA, 25 bp, Rattus norvegicus
tttccctcaaggagttctgctgaat

SEQ ID NO: 690366 - DNA, 25 bp, Rattus norvegicus
tttccctcaaggtgttctgctgaat

SEQ ID NO: 690367 - DNA, 25 bp, Rattus norvegicus
tttccctcacttaccagaagaccaa

SEQ ID NO: 690368 - DNA, 25 bp, Rattus norvegicus
tttccctcactttccagaagaccaa

SEQ ID NO: 690369 - DNA, 25 bp, Rattus norvegicus
tttccctcagccaggattactgttt

SEQ ID NO: 690370 - DNA, 25 bp, Rattus norvegicus
tttccctcagcctggattactgttt

SEQ ID NO: 690371 - DNA, 25 bp, Rattus norvegicus
tttccctcccttcgaacctgtgtag

SEQ ID NO: 690372 - DNA, 25 bp, Rattus norvegicus
tttccctcccttggaacctgtgtag

SEQ ID NO: 690373 - DNA, 25 bp, Rattus norvegicus
tttccctcctacagaattctttaat

SEQ ID NO: 690374 - DNA, 25 bp, Rattus norvegicus
tttccctcctactgaattctttaat

SEQ ID NO: 690375 - DNA, 25 bp, Rattus norvegicus
tttccctcgaaaaccatgttttcca

SEQ ID NO: 690376 - DNA, 25 bp, Rattus norvegicus
tttccctcgaaatccatgttttcca

SEQ ID NO: 690377 - DNA, 25 bp, Rattus norvegicus
tttccctctacacgttttgtgttgt

SEQ ID NO: 690378 - DNA, 25 bp, Rattus norvegicus
tttccctctacaggttttgtgttgt

SEQ ID NO: 690379 - DNA, 25 bp, Rattus norvegicus
tttccctctatgcaccttaaagaat

SEQ ID NO: 690380 - DNA, 25 bp, Rattus norvegicus
tttccctctatggaccttaaagaat

SEQ ID NO: 690381 - DNA, 25 bp, Rattus norvegicus
tttccctctctcagagtgtattgat

SEQ ID NO: 690382 - DNA, 25 bp, Rattus norvegicus
tttccctctctctgagtgtattgat

SEQ ID NO: 690383 - DNA, 25 bp, Rattus norvegicus
tttccctctggaattcattgtgcag

SEQ ID NO: 690384 - DNA, 25 bp, Rattus norvegicus
tttccctctggatttcattgtgcag

SEQ ID NO: 690385 - DNA, 25 bp, Rattus norvegicus
tttccctctgtgcactgtaatatac

SEQ ID NO: 690386 - DNA, 25 bp, Rattus norvegicus
tttccctctgtggactgtaatatac

SEQ ID NO: 690387 - DNA, 25 bp, Rattus norvegicus
tttccctcttcacagatgatccaag

SEQ ID NO: 690388 - DNA, 25 bp, Rattus norvegicus
tttccctcttcagagatgatccaag

SEQ ID NO: 690389 - DNA, 25 bp, Rattus norvegicus
tttccctgaaagctgctaccttcca

SEQ ID NO: 690390 - DNA, 25 bp, Rattus norvegicus
tttccctgaaaggtgctaccttcca

SEQ ID NO: 690391 - DNA, 25 bp, Rattus norvegicus
tttccctgaaggctatgagacacag

SEQ ID NO: 690392 - DNA, 25 bp, Rattus norvegicus
tttccctgaagggtatgagacacag

SEQ ID NO: 690393 - DNA, 25 bp, Rattus norvegicus
tttccctgaatactgccctagagag

SEQ ID NO: 690394 - DNA, 25 bp, Rattus norvegicus
tttccctgaatagtgccctagagag

SEQ ID NO: 690395 - DNA, 25 bp, Rattus norvegicus
tttccctgacttactctaacttgaa

SEQ ID NO: 690396 - DNA, 25 bp, Rattus norvegicus
tttccctgactttctctaacttgaa

SEQ ID NO: 690397 - DNA, 25 bp, Rattus norvegicus
tttccctgaggtatctgctgtcaaa

SEQ ID NO: 690398 - DNA, 25 bp, Rattus norvegicus
tttccctgaggtttctgctgtcaaa

SEQ ID NO: 690399 - DNA, 25 bp, Rattus norvegicus
tttccctgatatctttcctgaactg

SEQ ID NO: 690400 - DNA, 25 bp, Rattus norvegicus
tttccctgatatgtttcctgaactg

SEQ ID NO: 690401 - DNA, 25 bp, Rattus norvegicus
tttccctgcactatgttacatctgg

SEQ ID NO: 690402 - DNA, 25 bp, Rattus norvegicus
tttccctgcactttgttacatctgg

SEQ ID NO: 690403 - DNA, 25 bp, Rattus norvegicus
tttccctgccatactgagacataca

SEQ ID NO: 690404 - DNA, 25 bp, Rattus norvegicus
tttccctgccattctgagacataca

SEQ ID NO: 690405 - DNA, 25 bp, Rattus norvegicus
tttccctgccgtctttggatggaga

SEQ ID NO: 690406 - DNA, 25 bp, Rattus norvegicus
tttccctgccgtgtttggatggaga

SEQ ID NO: 690407 - DNA, 25 bp, Rattus norvegicus
tttccctgctataacctgtagtgag

SEQ ID NO: 690408 - DNA, 25 bp, Rattus norvegicus
tttccctgctattacctgtagtgag

SEQ ID NO: 690409 - DNA, 25 bp, Rattus norvegicus
tttccctgctgcatcatactgagga

SEQ ID NO: 690410 - DNA, 25 bp, Rattus norvegicus
tttccctgctgcttcatactgagga

SEQ ID NO: 690411 - DNA, 25 bp, Rattus norvegicus
tttccctgctgtactaccatttttt

SEQ ID NO: 690412 - DNA, 25 bp, Rattus norvegicus
tttccctgctgttctaccatttttt

SEQ ID NO: 690413 - DNA, 25 bp, Rattus norvegicus
tttccctggacgacagcctgtagtg

SEQ ID NO: 690414 - DNA, 25 bp, Rattus norvegicus
tttccctggacgtcagcctgtagtg

SEQ ID NO: 690415 - DNA, 25 bp, Rattus norvegicus
tttccctggctgcagaatggtttat

SEQ ID NO: 690416 - DNA, 25 bp, Rattus norvegicus
tttccctggctggagaatggtttat

SEQ ID NO: 690417 - DNA, 25 bp, Rattus norvegicus
tttccctgggaacgcaacggatcgc

SEQ ID NO: 690418 - DNA, 25 bp, Rattus norvegicus
tttccctgggaaggcaacggatcgc

SEQ ID NO: 690419 - DNA, 25 bp, Rattus norvegicus
tttccctggtttactccagaacagg

SEQ ID NO: 690420 - DNA, 25 bp, Rattus norvegicus
tttccctggttttctccagaacagg

SEQ ID NO: 690421 - DNA, 25 bp, Rattus norvegicus
tttccctgtctcctggatgctggga

SEQ ID NO: 690422 - DNA, 25 bp, Rattus norvegicus
tttccctgtctcgtggatgctggga

SEQ ID NO: 690423 - DNA, 25 bp, Rattus norvegicus
tttccctgtcttcattctctccaaa

SEQ ID NO: 690424 - DNA, 25 bp, Rattus norvegicus
tttccctgtcttgattctctccaaa

SEQ ID NO: 690425 - DNA, 25 bp, Rattus norvegicus
tttccctgtggtcagtcatgtgttg

SEQ ID NO: 690426 - DNA, 25 bp, Rattus norvegicus
tttccctgtggtgagtcatgtgttg

SEQ ID NO: 690427 - DNA, 25 bp, Rattus norvegicus
tttccctgtgttcctgtaactaatc

SEQ ID NO: 690428 - DNA, 25 bp, Rattus norvegicus
tttccctgtgttgctgtaactaatc

SEQ ID NO: 690429 - DNA, 25 bp, Rattus norvegicus
tttccctgttggctacaatgataga

SEQ ID NO: 690430 - DNA, 25 bp, Rattus norvegicus
tttccctgttgggtacaatgataga

SEQ ID NO: 690431 - DNA, 25 bp, Rattus norvegicus
tttccctgttttctctattctatcc

SEQ ID NO: 690432 - DNA, 25 bp, Rattus norvegicus
tttccctgttttgtctattctatcc

SEQ ID NO: 690433 - DNA, 25 bp, Rattus norvegicus
tttcccttagtgagatccataccca

SEQ ID NO: 690434 - DNA, 25 bp, Rattus norvegicus
tttcccttagtgaggtgatgctcgg

SEQ ID NO: 690435 - DNA, 25 bp, Rattus norvegicus
tttcccttagtgtgatccataccca

SEQ ID NO: 690436 - DNA, 25 bp, Rattus norvegicus
tttcccttagtgtggtgatgctcgg

SEQ ID NO: 690437 - DNA, 25 bp, Rattus norvegicus
tttcccttcagcatcacgaaaggca

SEQ ID NO: 690438 - DNA, 25 bp, Rattus norvegicus
tttcccttcagcatttcacacaagt

SEQ ID NO: 690439 - DNA, 25 bp, Rattus norvegicus
tttcccttcagcttcacgaaaggca

SEQ ID NO: 690440 - DNA, 25 bp, Rattus norvegicus
tttcccttcagcttttcacacaagt

SEQ ID NO: 690441 - DNA, 25 bp, Rattus norvegicus
tttcccttccagcatcatctttaca

SEQ ID NO: 690442 - DNA, 25 bp, Rattus norvegicus
tttcccttccaggatcatctttaca

SEQ ID NO: 690443 - DNA, 25 bp, Rattus norvegicus
tttcccttccatagttctagacttt

SEQ ID NO: 690444 - DNA, 25 bp, Rattus norvegicus
tttcccttccattgttctagacttt

SEQ ID NO: 690445 - DNA, 25 bp, Rattus norvegicus
tttcccttcctaactgcagacagtc

SEQ ID NO: 690446 - DNA, 25 bp, Rattus norvegicus
tttcccttcctatctgcagacagtc

SEQ ID NO: 690447 - DNA, 25 bp, Rattus norvegicus
tttcccttcggtatgtatatttgat

SEQ ID NO: 690448 - DNA, 25 bp, Rattus norvegicus
tttcccttcggtttgtatatttgat

SEQ ID NO: 690449 - DNA, 25 bp, Rattus norvegicus
tttcccttcgttaggcagcaggaga

SEQ ID NO: 690450 - DNA, 25 bp, Rattus norvegicus
tttcccttcgtttggcagcaggaga

SEQ ID NO: 690451 - DNA, 25 bp, Rattus norvegicus
tttcccttctgcacaggaacatgaa

SEQ ID NO: 690452 - DNA, 25 bp, Rattus norvegicus
tttcccttctgctcaggaacatgaa

SEQ ID NO: 690453 - DNA, 25 bp, Rattus norvegicus
tttcccttgactctgaatgctctta

SEQ ID NO: 690454 - DNA, 25 bp, Rattus norvegicus
tttcccttgactgtgaatgctctta

SEQ ID NO: 690455 - DNA, 25 bp, Rattus norvegicus
tttcccttgataaaagatcccctga

SEQ ID NO: 690456 - DNA, 25 bp, Rattus norvegicus
tttcccttgatataagatcccctga

SEQ ID NO: 690457 - DNA, 25 bp, Rattus norvegicus
tttcccttgatcatgctgctgacat

SEQ ID NO: 690458 - DNA, 25 bp, Rattus norvegicus
tttcccttgatcttgctgctgacat

SEQ ID NO: 690459 - DNA, 25 bp, Rattus norvegicus
tttcccttgccccagtggatgaaaa

SEQ ID NO: 690460 - DNA, 25 bp, Rattus norvegicus
tttcccttgcccgagtggatgaaaa

SEQ ID NO: 690461 - DNA, 25 bp, Rattus norvegicus
tttcccttggaaagttacagtctat

SEQ ID NO: 690462 - DNA, 25 bp, Rattus norvegicus
tttcccttggaatgttacagtctat

SEQ ID NO: 690463 - DNA, 25 bp, Rattus norvegicus
tttcccttgggacatcatttattta

SEQ ID NO: 690464 - DNA, 25 bp, Rattus norvegicus
tttcccttgggagatcatttattta

SEQ ID NO: 690465 - DNA, 25 bp, Rattus norvegicus
tttcccttgggcacgaggccctgat

SEQ ID NO: 690466 - DNA, 25 bp, Rattus norvegicus
tttcccttgggcattgctgacacag

SEQ ID NO: 690467 - DNA, 25 bp, Rattus norvegicus
tttcccttgggctcgaggccctgat

SEQ ID NO: 690468 - DNA, 25 bp, Rattus norvegicus
tttcccttgggctttgctgacacag

SEQ ID NO: 690469 - DNA, 25 bp, Rattus norvegicus
tttcccttgtacattctgtatacat

SEQ ID NO: 690470 - DNA, 25 bp, Rattus norvegicus
tttcccttgtactttctgtatacat

SEQ ID NO: 690471 - DNA, 25 bp, Rattus norvegicus
tttccctttcataacagatgtcaag

SEQ ID NO: 690472 - DNA, 25 bp, Rattus norvegicus
tttccctttcattacagatgtcaag

SEQ ID NO: 690473 - DNA, 25 bp, Rattus norvegicus
tttccctttccaccatacaatgtgt

SEQ ID NO: 690474 - DNA, 25 bp, Rattus norvegicus
tttccctttccagcatacaatgtgt

SEQ ID NO: 690475 - DNA, 25 bp, Rattus norvegicus
tttccctttggactcgctatacatc

SEQ ID NO: 690476 - DNA, 25 bp, Rattus norvegicus
tttccctttggagtcgctatacatc

SEQ ID NO: 690477 - DNA, 25 bp, Rattus norvegicus
tttcccttttccagtgcagtcttta

SEQ ID NO: 690478 - DNA, 25 bp, Rattus norvegicus
tttcccttttccctacattagcatt

SEQ ID NO: 690479 - DNA, 25 bp, Rattus norvegicus
tttcccttttccgtacattagcatt

SEQ ID NO: 690480 - DNA, 25 bp, Rattus norvegicus
tttcccttttcctgtgcagtcttta

SEQ ID NO: 690481 - DNA, 25 bp, Rattus norvegicus
tttccctttttacaatctctgtcca

SEQ ID NO: 690482 - DNA, 25 bp, Rattus norvegicus
tttccctttttagaatctctgtcca

SEQ ID NO: 690483 - DNA, 25 bp, Rattus norvegicus
tttccgaatcccaaatgccaatgtg

SEQ ID NO: 690484 - DNA, 25 bp, Rattus norvegicus
tttccgaatccctaatgccaatgtg

SEQ ID NO: 690485 - DNA, 25 bp, Rattus norvegicus
tttccgacctccatggagtttgaag

SEQ ID NO: 690486 - DNA, 25 bp, Rattus norvegicus
tttccgacctccttggagtttgaag

SEQ ID NO: 690487 - DNA, 25 bp, Rattus norvegicus
tttccgaggaagctgcctttgcact

SEQ ID NO: 690488 - DNA, 25 bp, Rattus norvegicus
tttccgaggaaggtgcctttgcact

SEQ ID NO: 690489 - DNA, 25 bp, Rattus norvegicus
tttccgataatcacagcttctgctc

SEQ ID NO: 690490 - DNA, 25 bp, Rattus norvegicus
tttccgataatctcagcttctgctc

SEQ ID NO: 690491 - DNA, 25 bp, Rattus norvegicus
tttccgatagcccacgtgtaatgta

SEQ ID NO: 690492 - DNA, 25 bp, Rattus norvegicus
tttccgatagccgacgtgtaatgta

SEQ ID NO: 690493 - DNA, 25 bp, Rattus norvegicus
tttccgatagtaaggcatccagatg

SEQ ID NO: 690494 - DNA, 25 bp, Rattus norvegicus
tttccgatagtatggcatccagatg

SEQ ID NO: 690495 - DNA, 25 bp, Rattus norvegicus
tttccgatgccaccaaaggaaggat

SEQ ID NO: 690496 - DNA, 25 bp, Rattus norvegicus
tttccgatgccagcaaaggaaggat

SEQ ID NO: 690497 - DNA, 25 bp, Rattus norvegicus
tttccgcacattctagcatctacct

SEQ ID NO: 690498 - DNA, 25 bp, Rattus norvegicus
tttccgcacattgtagcatctacct

SEQ ID NO: 690499 - DNA, 25 bp, Rattus norvegicus
tttccgcagctgaaccgtctaatct

SEQ ID NO: 690500 - DNA, 25 bp, Rattus norvegicus
tttccgcagctgtaccgtctaatct

SEQ ID NO: 690501 - DNA, 25 bp, Rattus norvegicus
tttccgcagtcaacagtaccagcga

SEQ ID NO: 690502 - DNA, 25 bp, Rattus norvegicus
tttccgcagtcatcagtaccagcga

SEQ ID NO: 690503 - DNA, 25 bp, Rattus norvegicus
tttccgcattgtaaccaggtgtctt

SEQ ID NO: 690504 - DNA, 25 bp, Rattus norvegicus
tttccgcattgttaccaggtgtctt

SEQ ID NO: 690505 - DNA, 25 bp, Rattus norvegicus
tttccgccatagcagaccatgtgac

SEQ ID NO: 690506 - DNA, 25 bp, Rattus norvegicus
tttccgccataggagaccatgtgac

SEQ ID NO: 690507 - DNA, 25 bp, Rattus norvegicus
tttccgccattgcaacagagatctt

SEQ ID NO: 690508 - DNA, 25 bp, Rattus norvegicus
tttccgccattggaacagagatctt

SEQ ID NO: 690509 - DNA, 25 bp, Rattus norvegicus
tttccgcccggaagcaagactggat

SEQ ID NO: 690510 - DNA, 25 bp, Rattus norvegicus
tttccgcccggatgcaagactggat

SEQ ID NO: 690511 - DNA, 25 bp, Rattus norvegicus
tttccgccctgcaggccgaggtggc

SEQ ID NO: 690512 - DNA, 25 bp, Rattus norvegicus
tttccgccctgctggccgaggtggc

SEQ ID NO: 690513 - DNA, 25 bp, Rattus norvegicus
tttccgcgatgcaaaagggctgcaa

SEQ ID NO: 690514 - DNA, 25 bp, Rattus norvegicus
tttccgcgatgctaaagggctgcaa

SEQ ID NO: 690515 - DNA, 25 bp, Rattus norvegicus
tttccgctgagtccagattggcagg

SEQ ID NO: 690516 - DNA, 25 bp, Rattus norvegicus
tttccgctgagtgcagattggcagg

SEQ ID NO: 690517 - DNA, 25 bp, Rattus norvegicus
tttccgctgcttcttggccaaggtg

SEQ ID NO: 690518 - DNA, 25 bp, Rattus norvegicus
tttccgctgcttgttggccaaggtg

SEQ ID NO: 690519 - DNA, 25 bp, Rattus norvegicus
tttccgctggagagactactgatgt

SEQ ID NO: 690520 - DNA, 25 bp, Rattus norvegicus
tttccgctggagtgactactgatgt

SEQ ID NO: 690521 - DNA, 25 bp, Rattus norvegicus
tttccgctgtagcagttactcgaca

SEQ ID NO: 690522 - DNA, 25 bp, Rattus norvegicus
tttccgctgtaggagttactcgaca

SEQ ID NO: 690523 - DNA, 25 bp, Rattus norvegicus
tttccggacagacagagccagggta

SEQ ID NO: 690524 - DNA, 25 bp, Rattus norvegicus
tttccggacagagagagccagggta

SEQ ID NO: 690525 - DNA, 25 bp, Rattus norvegicus
tttccggacagcaccagaagcctgg

SEQ ID NO: 690526 - DNA, 25 bp, Rattus norvegicus
tttccggacagctccagaagcctgg

SEQ ID NO: 690527 - DNA, 25 bp, Rattus norvegicus
tttccggaggagacccaagtgctgt

SEQ ID NO: 690528 - DNA, 25 bp, Rattus norvegicus
tttccggaggagtcccaagtgctgt

SEQ ID NO: 690529 - DNA, 25 bp, Rattus norvegicus
tttccggatctgctagggctataaa

SEQ ID NO: 690530 - DNA, 25 bp, Rattus norvegicus
tttccggatctggtagggctataaa

SEQ ID NO: 690531 - DNA, 25 bp, Rattus norvegicus
tttccggcaccccttaaactgacag

SEQ ID NO: 690532 - DNA, 25 bp, Rattus norvegicus
tttccggcacccgttaaactgacag

SEQ ID NO: 690533 - DNA, 25 bp, Rattus norvegicus
tttccggccgggagagatgttgctt

SEQ ID NO: 690534 - DNA, 25 bp, Rattus norvegicus
tttccggccgggtgagatgttgctt

SEQ ID NO: 690535 - DNA, 25 bp, Rattus norvegicus
tttccgggatgcagctcagtcaagc

SEQ ID NO: 690536 - DNA, 25 bp, Rattus norvegicus
tttccgggatgctgctcagtcaagc

SEQ ID NO: 690537 - DNA, 25 bp, Rattus norvegicus
tttccgggcaccacgagtgaaaaag

SEQ ID NO: 690538 - DNA, 25 bp, Rattus norvegicus
tttccgggcacctcgagtgaaaaag

SEQ ID NO: 690539 - DNA, 25 bp, Rattus norvegicus
tttccgggtgtcagggacgtcctca

SEQ ID NO: 690540 - DNA, 25 bp, Rattus norvegicus
tttccgggtgtctgggacgtcctca

SEQ ID NO: 690541 - DNA, 25 bp, Rattus norvegicus
tttccggtggtcaatgtcagtcctg

SEQ ID NO: 690542 - DNA, 25 bp, Rattus norvegicus
tttccggtggtctatgtcagtcctg

SEQ ID NO: 690543 - DNA, 25 bp, Rattus norvegicus
tttccgtaagcacgtgcggctctta

SEQ ID NO: 690544 - DNA, 25 bp, Rattus norvegicus
tttccgtaagcaggtgcggctctta

SEQ ID NO: 690545 - DNA, 25 bp, Rattus norvegicus
tttccgtactgcagagcttactcaa

SEQ ID NO: 690546 - DNA, 25 bp, Rattus norvegicus
tttccgtactgctgagcttactcaa

SEQ ID NO: 690547 - DNA, 25 bp, Rattus norvegicus
tttccgtactttcgccacaacggat

SEQ ID NO: 690548 - DNA, 25 bp, Rattus norvegicus
tttccgtactttggccacaacggat

SEQ ID NO: 690549 - DNA, 25 bp, Rattus norvegicus
tttccgtaggccctcatttgatgaa

SEQ ID NO: 690550 - DNA, 25 bp, Rattus norvegicus
tttccgtaggccgtcatttgatgaa

SEQ ID NO: 690551 - DNA, 25 bp, Rattus norvegicus
tttccgtccacaccagtttttcatg

SEQ ID NO: 690552 - DNA, 25 bp, Rattus norvegicus
tttccgtccacagcagtttttcatg

SEQ ID NO: 690553 - DNA, 25 bp, Rattus norvegicus
tttccgtcgtaaagatccgaaattc

SEQ ID NO: 690554 - DNA, 25 bp, Rattus norvegicus
tttccgtcgtaatgatccgaaattc

SEQ ID NO: 690555 - DNA, 25 bp, Rattus norvegicus
tttccgtgaggcatttggaccatgg

SEQ ID NO: 690556 - DNA, 25 bp, Rattus norvegicus
tttccgtgaggcttttggaccatgg

SEQ ID NO: 690557 - DNA, 25 bp, Rattus norvegicus
tttccgtgccacagagctgtcagga

SEQ ID NO: 690558 - DNA, 25 bp, Rattus norvegicus
tttccgtgccactgagctgtcagga

SEQ ID NO: 690559 - DNA, 25 bp, Rattus norvegicus
tttccgtgccagctgcgatcgactg

SEQ ID NO: 690560 - DNA, 25 bp, Rattus norvegicus
tttccgtgccaggtgcgatcgactg

SEQ ID NO: 690561 - DNA, 25 bp, Rattus norvegicus
tttccgtggactctcagacatgcta

SEQ ID NO: 690562 - DNA, 25 bp, Rattus norvegicus
tttccgtggactgtcagacatgcta

SEQ ID NO: 690563 - DNA, 25 bp, Rattus norvegicus
tttccgtggctcatgagactcttca

SEQ ID NO: 690564 - DNA, 25 bp, Rattus norvegicus
tttccgtggctcttgagactcttca

SEQ ID NO: 690565 - DNA, 25 bp, Rattus norvegicus
tttccgttcacaacagccttagaag

SEQ ID NO: 690566 - DNA, 25 bp, Rattus norvegicus
tttccgttcacatcagccttagaag

SEQ ID NO: 690567 - DNA, 25 bp, Rattus norvegicus
tttccgttgcccaggtgacgtgtaa

SEQ ID NO: 690568 - DNA, 25 bp, Rattus norvegicus
tttccgttgccctggtgacgtgtaa

SEQ ID NO: 690569 - DNA, 25 bp, Rattus norvegicus
tttccgtttgttacccatcaggaat

SEQ ID NO: 690570 - DNA, 25 bp, Rattus norvegicus
tttccgtttgtttcccatcaggaat

SEQ ID NO: 690571 - DNA, 25 bp, Rattus norvegicus
tttcctaaagcccttgagcctgtag

SEQ ID NO: 690572 - DNA, 25 bp, Rattus norvegicus
tttcctaaagccgttgagcctgtag

SEQ ID NO: 690573 - DNA, 25 bp, Rattus norvegicus
tttcctaagagcagcattacctaat

SEQ ID NO: 690574 - DNA, 25 bp, Rattus norvegicus
tttcctaagagctgcattacctaat

SEQ ID NO: 690575 - DNA, 25 bp, Rattus norvegicus
tttcctaagcttcagtctgcagcca

SEQ ID NO: 690576 - DNA, 25 bp, Rattus norvegicus
tttcctaagcttgagtctgcagcca

SEQ ID NO: 690577 - DNA, 25 bp, Rattus norvegicus
tttcctaaggacagacgtacacaat

SEQ ID NO: 690578 - DNA, 25 bp, Rattus norvegicus
tttcctaaggactgacgtacacaat

SEQ ID NO: 690579 - DNA, 25 bp, Rattus norvegicus
tttcctaagggtatcttgtctgttg

SEQ ID NO: 690580 - DNA, 25 bp, Rattus norvegicus
tttcctaagggtttcttgtctgttg

SEQ ID NO: 690581 - DNA, 25 bp, Rattus norvegicus
tttcctaccaccatttctaagctct

SEQ ID NO: 690582 - DNA, 25 bp, Rattus norvegicus
tttcctaccaccttttctaagctct

SEQ ID NO: 690583 - DNA, 25 bp, Rattus norvegicus
tttcctaccattattgattcttgat

SEQ ID NO: 690584 - DNA, 25 bp, Rattus norvegicus
tttcctaccatttttgattcttgat

SEQ ID NO: 690585 - DNA, 25 bp, Rattus norvegicus
tttcctacccagctcgaggcttaga

SEQ ID NO: 690586 - DNA, 25 bp, Rattus norvegicus
tttcctacccaggtcgaggcttaga

SEQ ID NO: 690587 - DNA, 25 bp, Rattus norvegicus
tttcctaccctgagtctcatttgta

SEQ ID NO: 690588 - DNA, 25 bp, Rattus norvegicus
tttcctaccctgtgtctcatttgta

SEQ ID NO: 690589 - DNA, 25 bp, Rattus norvegicus
tttcctaccgagcagaacaggctca

SEQ ID NO: 690590 - DNA, 25 bp, Rattus norvegicus
tttcctaccgaggagaacaggctca

SEQ ID NO: 690591 - DNA, 25 bp, Rattus norvegicus
tttcctacttgtcacttttactaat

SEQ ID NO: 690592 - DNA, 25 bp, Rattus norvegicus
tttcctacttgtgacttttactaat

SEQ ID NO: 690593 - DNA, 25 bp, Rattus norvegicus
tttcctactttacttcagactgctt

SEQ ID NO: 690594 - DNA, 25 bp, Rattus norvegicus
tttcctactttagttcagactgctt

SEQ ID NO: 690595 - DNA, 25 bp, Rattus norvegicus
tttcctactttgcagctttgctgat

SEQ ID NO: 690596 - DNA, 25 bp, Rattus norvegicus
tttcctactttggagctttgctgat

SEQ ID NO: 690597 - DNA, 25 bp, Rattus norvegicus
tttcctacttttcagcaccgatgat

SEQ ID NO: 690598 - DNA, 25 bp, Rattus norvegicus
tttcctacttttgagcaccgatgat

SEQ ID NO: 690599 - DNA, 25 bp, Rattus norvegicus
tttcctagaaacaagcgcaaagtga

SEQ ID NO: 690600 - DNA, 25 bp, Rattus norvegicus
tttcctagaaactagcgcaaagtga

SEQ ID NO: 690601 - DNA, 25 bp, Rattus norvegicus
tttcctagcagcatgttatcactgg

SEQ ID NO: 690602 - DNA, 25 bp, Rattus norvegicus
tttcctagcagcttgttatcactgg

SEQ ID NO: 690603 - DNA, 25 bp, Rattus norvegicus
tttcctagcaggagggatccccagc

SEQ ID NO: 690604 - DNA, 25 bp, Rattus norvegicus
tttcctagcaggtgggatccccagc

SEQ ID NO: 690605 - DNA, 25 bp, Rattus norvegicus
tttcctagggaccatcagtgtcttt

SEQ ID NO: 690606 - DNA, 25 bp, Rattus norvegicus
tttcctagggacgatcagtgtcttt

SEQ ID NO: 690607 - DNA, 25 bp, Rattus norvegicus
tttcctaggttacacaaagccagtc

SEQ ID NO: 690608 - DNA, 25 bp, Rattus norvegicus
tttcctaggttagacaaagccagtc

SEQ ID NO: 690609 - DNA, 25 bp, Rattus norvegicus
tttcctataccgactcagtaaccag

SEQ ID NO: 690610 - DNA, 25 bp, Rattus norvegicus
tttcctataccgtctcagtaaccag

SEQ ID NO: 690611 - DNA, 25 bp, Rattus norvegicus
tttcctatcaagactctggctcctt

SEQ ID NO: 690612 - DNA, 25 bp, Rattus norvegicus
tttcctatcaagtctctggctcctt

SEQ ID NO: 690613 - DNA, 25 bp, Rattus norvegicus
tttcctatcccactaaatatgaggt

SEQ ID NO: 690614 - DNA, 25 bp, Rattus norvegicus
tttcctatcccagtaaatatgaggt

SEQ ID NO: 690615 - DNA, 25 bp, Rattus norvegicus
tttcctatctctactgctaagtggg

SEQ ID NO: 690616 - DNA, 25 bp, Rattus norvegicus
tttcctatctcttctgctaagtggg

SEQ ID NO: 690617 - DNA, 25 bp, Rattus norvegicus
tttcctattgtaccattgtcagacg

SEQ ID NO: 690618 - DNA, 25 bp, Rattus norvegicus
tttcctattgtagcattgtcagacg

SEQ ID NO: 690619 - DNA, 25 bp, Rattus norvegicus
tttcctcaaccactgtcggatgatg

SEQ ID NO: 690620 - DNA, 25 bp, Rattus norvegicus
tttcctcaaccagtgtcggatgatg

SEQ ID NO: 690621 - DNA, 25 bp, Rattus norvegicus
tttcctcaagacaaactgctgtgtt

SEQ ID NO: 690622 - DNA, 25 bp, Rattus norvegicus
tttcctcaagactaactgctgtgtt

SEQ ID NO: 690623 - DNA, 25 bp, Rattus norvegicus
tttcctcaagttcaaagcatcaata

SEQ ID NO: 690624 - DNA, 25 bp, Rattus norvegicus
tttcctcaagttgaaagcatcaata

SEQ ID NO: 690625 - DNA, 25 bp, Rattus norvegicus
tttcctcaattgactgttggcacct

SEQ ID NO: 690626 - DNA, 25 bp, Rattus norvegicus
tttcctcaattgtctgttggcacct

SEQ ID NO: 690627 - DNA, 25 bp, Rattus norvegicus
tttcctcaccacatgcaaactagtt

SEQ ID NO: 690628 - DNA, 25 bp, Rattus norvegicus
tttcctcaccacttgcaaactagtt

SEQ ID NO: 690629 - DNA, 25 bp, Rattus norvegicus
tttcctcaccttcgagactcctgta

SEQ ID NO: 690630 - DNA, 25 bp, Rattus norvegicus
tttcctcaccttggagactcctgta

SEQ ID NO: 690631 - DNA, 25 bp, Rattus norvegicus
tttcctcagagaacacatgcgctat

SEQ ID NO: 690632 - DNA, 25 bp, Rattus norvegicus
tttcctcagagatcacatgcgctat

SEQ ID NO: 690633 - DNA, 25 bp, Rattus norvegicus
tttcctcagatgagacttgctctgt

SEQ ID NO: 690634 - DNA, 25 bp, Rattus norvegicus
tttcctcagatgtgacttgctctgt

SEQ ID NO: 690635 - DNA, 25 bp, Rattus norvegicus
tttcctcaggcacatcatttttatc

SEQ ID NO: 690636 - DNA, 25 bp, Rattus norvegicus
tttcctcaggcagatcatttttatc

SEQ ID NO: 690637 - DNA, 25 bp, Rattus norvegicus
tttcctcaggcccttttacttctgg

SEQ ID NO: 690638 - DNA, 25 bp, Rattus norvegicus
tttcctcaggccgttttacttctgg

SEQ ID NO: 690639 - DNA, 25 bp, Rattus norvegicus
tttcctcagtgtatagtctgcattt

SEQ ID NO: 690640 - DNA, 25 bp, Rattus norvegicus
tttcctcagtgtttagtctgcattt

SEQ ID NO: 690641 - DNA, 25 bp, Rattus norvegicus
tttcctcatcccatgagctgaatga

SEQ ID NO: 690642 - DNA, 25 bp, Rattus norvegicus
tttcctcatcccttgagctgaatga

SEQ ID NO: 690643 - DNA, 25 bp, Rattus norvegicus
tttcctcatcttcttgccttagaag

SEQ ID NO: 690644 - DNA, 25 bp, Rattus norvegicus
tttcctcatcttgttgccttagaag

SEQ ID NO: 690645 - DNA, 25 bp, Rattus norvegicus
tttcctccaagtctgtcatgctcaa

SEQ ID NO: 690646 - DNA, 25 bp, Rattus norvegicus
tttcctccaagtgtgtcatgctcaa

SEQ ID NO: 690647 - DNA, 25 bp, Rattus norvegicus
tttcctccacaccaaaagatcattc

SEQ ID NO: 690648 - DNA, 25 bp, Rattus norvegicus
tttcctccacacgaaaagatcattc

SEQ ID NO: 690649 - DNA, 25 bp, Rattus norvegicus
tttcctccacgccatcaaatatgaa

SEQ ID NO: 690650 - DNA, 25 bp, Rattus norvegicus
tttcctccacgcgatcaaatatgaa

SEQ ID NO: 690651 - DNA, 25 bp, Rattus norvegicus
tttcctccacggagtaacctgtaag

SEQ ID NO: 690652 - DNA, 25 bp, Rattus norvegicus
tttcctccacggtgtaacctgtaag

SEQ ID NO: 690653 - DNA, 25 bp, Rattus norvegicus
tttcctccagtaacaaagacctctc

SEQ ID NO: 690654 - DNA, 25 bp, Rattus norvegicus
tttcctccagtatcaaagacctctc

SEQ ID NO: 690655 - DNA, 25 bp, Rattus norvegicus
tttcctccagtcaccattttgtttt

SEQ ID NO: 690656 - DNA, 25 bp, Rattus norvegicus
tttcctccagtctccattttgtttt

SEQ ID NO: 690657 - DNA, 25 bp, Rattus norvegicus
tttcctccatcccaaagactgtggt

SEQ ID NO: 690658 - DNA, 25 bp, Rattus norvegicus
tttcctccatccgaaagactgtggt

SEQ ID NO: 690659 - DNA, 25 bp, Rattus norvegicus
tttcctccattgagccctgaaagta

SEQ ID NO: 690660 - DNA, 25 bp, Rattus norvegicus
tttcctccattgtgccctgaaagta

SEQ ID NO: 690661 - DNA, 25 bp, Rattus norvegicus
tttcctcccaataacagcaagactg

SEQ ID NO: 690662 - DNA, 25 bp, Rattus norvegicus
tttcctcccaatcgaaggtggctga

SEQ ID NO: 690663 - DNA, 25 bp, Rattus norvegicus
tttcctcccaatggaaggtggctga

SEQ ID NO: 690664 - DNA, 25 bp, Rattus norvegicus
tttcctcccaattacagcaagactg

SEQ ID NO: 690665 - DNA, 25 bp, Rattus norvegicus
tttcctcccaggcttgagacaaggt

SEQ ID NO: 690666 - DNA, 25 bp, Rattus norvegicus
tttcctcccagggttgagacaaggt

SEQ ID NO: 690667 - DNA, 25 bp, Rattus norvegicus
tttcctcccagtaaagattaacatt

SEQ ID NO: 690668 - DNA, 25 bp, Rattus norvegicus
tttcctcccagttaagattaacatt

SEQ ID NO: 690669 - DNA, 25 bp, Rattus norvegicus
tttcctcccctgcttaaaattgtag

SEQ ID NO: 690670 - DNA, 25 bp, Rattus norvegicus
tttcctcccctggttaaaattgtag

SEQ ID NO: 690671 - DNA, 25 bp, Rattus norvegicus
tttcctccccttattatgatccatg

SEQ ID NO: 690672 - DNA, 25 bp, Rattus norvegicus
tttcctcccctttttatgatccatg

SEQ ID NO: 690673 - DNA, 25 bp, Rattus norvegicus
tttcctccctacactgataggattg

SEQ ID NO: 690674 - DNA, 25 bp, Rattus norvegicus
tttcctccctactctgataggattg

SEQ ID NO: 690675 - DNA, 25 bp, Rattus norvegicus
tttcctccctctattggattctaag

SEQ ID NO: 690676 - DNA, 25 bp, Rattus norvegicus
tttcctccctcttttggattctaag

SEQ ID NO: 690677 - DNA, 25 bp, Rattus norvegicus
tttcctcctcagcagagacagggtt

SEQ ID NO: 690678 - DNA, 25 bp, Rattus norvegicus
tttcctcctcaggagagacagggtt

SEQ ID NO: 690679 - DNA, 25 bp, Rattus norvegicus
tttcctcctcataggccagctggta

SEQ ID NO: 690680 - DNA, 25 bp, Rattus norvegicus
tttcctcctcattggccagctggta

SEQ ID NO: 690681 - DNA, 25 bp, Rattus norvegicus
tttcctcctcttcgacgtgaagatt

SEQ ID NO: 690682 - DNA, 25 bp, Rattus norvegicus
tttcctcctcttggacgtgaagatt

SEQ ID NO: 690683 - DNA, 25 bp, Rattus norvegicus
tttcctcctgccctgtgggcagcag

SEQ ID NO: 690684 - DNA, 25 bp, Rattus norvegicus
tttcctcctgccgtgtgggcagcag

SEQ ID NO: 690685 - DNA, 25 bp, Rattus norvegicus
tttcctccttctagattgccttgtt

SEQ ID NO: 690686 - DNA, 25 bp, Rattus norvegicus
tttcctccttcttgattgccttgtt

SEQ ID NO: 690687 - DNA, 25 bp, Rattus norvegicus
tttcctccttgcattaggtgaaagc

SEQ ID NO: 690688 - DNA, 25 bp, Rattus norvegicus
tttcctccttgctttaggtgaaagc

SEQ ID NO: 690689 - DNA, 25 bp, Rattus norvegicus
tttcctccttgtcttggttatgcgt

SEQ ID NO: 690690 - DNA, 25 bp, Rattus norvegicus
tttcctccttgtgttggttatgcgt

SEQ ID NO: 690691 - DNA, 25 bp, Rattus norvegicus
tttcctcctttacttcttgaagcag

SEQ ID NO: 690692 - DNA, 25 bp, Rattus norvegicus
tttcctcctttagttcttgaagcag

SEQ ID NO: 690693 - DNA, 25 bp, Rattus norvegicus
tttcctcctttgctagtgtctggta

SEQ ID NO: 690694 - DNA, 25 bp, Rattus norvegicus
tttcctcctttggtagtgtctggta

SEQ ID NO: 690695 - DNA, 25 bp, Rattus norvegicus
tttcctccttttaacagtttctctg

SEQ ID NO: 690696 - DNA, 25 bp, Rattus norvegicus
tttcctccttttcctgatggtcatt

SEQ ID NO: 690697 - DNA, 25 bp, Rattus norvegicus
tttcctccttttgctgatggtcatt

SEQ ID NO: 690698 - DNA, 25 bp, Rattus norvegicus
tttcctcctttttacagtttctctg

SEQ ID NO: 690699 - DNA, 25 bp, Rattus norvegicus
tttcctcgaaagaagtagatctcct

SEQ ID NO: 690700 - DNA, 25 bp, Rattus norvegicus
tttcctcgaaagtagtagatctcct

SEQ ID NO: 690701 - DNA, 25 bp, Rattus norvegicus
tttcctcgagcccaggttggtggtt

SEQ ID NO: 690702 - DNA, 25 bp, Rattus norvegicus
tttcctcgagccgaggttggtggtt

SEQ ID NO: 690703 - DNA, 25 bp, Rattus norvegicus
tttcctcgcattctgggagcgcagg

SEQ ID NO: 690704 - DNA, 25 bp, Rattus norvegicus
tttcctcgcattgtgggagcgcagg

SEQ ID NO: 690705 - DNA, 25 bp, Rattus norvegicus
tttcctcggtggaaaagaagacctg

SEQ ID NO: 690706 - DNA, 25 bp, Rattus norvegicus
tttcctcggtggtaaagaagacctg

SEQ ID NO: 690707 - DNA, 25 bp, Rattus norvegicus
tttcctcgtaaacctatcctgtttc

SEQ ID NO: 690708 - DNA, 25 bp, Rattus norvegicus
tttcctcgtaaagctatcctgtttc

SEQ ID NO: 690709 - DNA, 25 bp, Rattus norvegicus
tttcctctaaggacttggcagcctg

SEQ ID NO: 690710 - DNA, 25 bp, Rattus norvegicus
tttcctctaaggtcttggcagcctg

SEQ ID NO: 690711 - DNA, 25 bp, Rattus norvegicus
tttcctctagaaaattttcgagtgt

SEQ ID NO: 690712 - DNA, 25 bp, Rattus norvegicus
tttcctctagaatattttcgagtgt

SEQ ID NO: 690713 - DNA, 25 bp, Rattus norvegicus
tttcctctagacactctaggctctt

SEQ ID NO: 690714 - DNA, 25 bp, Rattus norvegicus
tttcctctagactctctaggctctt

SEQ ID NO: 690715 - DNA, 25 bp, Rattus norvegicus
tttcctctcaataacatgacctcgt

SEQ ID NO: 690716 - DNA, 25 bp, Rattus norvegicus
tttcctctcaattacatgacctcgt

SEQ ID NO: 690717 - DNA, 25 bp, Rattus norvegicus
tttcctctcaccagtactagaactt

SEQ ID NO: 690718 - DNA, 25 bp, Rattus norvegicus
tttcctctcacctgtactagaactt

SEQ ID NO: 690719 - DNA, 25 bp, Rattus norvegicus
tttcctctcaggctctcccatggat

SEQ ID NO: 690720 - DNA, 25 bp, Rattus norvegicus
tttcctctcagggtctcccatggat

SEQ ID NO: 690721 - DNA, 25 bp, Rattus norvegicus
tttcctctccataatttgcttacag

SEQ ID NO: 690722 - DNA, 25 bp, Rattus norvegicus
tttcctctccattatttgcttacag

SEQ ID NO: 690723 - DNA, 25 bp, Rattus norvegicus
tttcctctctctaatcagtgttcta

SEQ ID NO: 690724 - DNA, 25 bp, Rattus norvegicus
tttcctctctcttatcagtgttcta

SEQ ID NO: 690725 - DNA, 25 bp, Rattus norvegicus
tttcctctcttccagcagtgcaaag

SEQ ID NO: 690726 - DNA, 25 bp, Rattus norvegicus
tttcctctcttcgagcagtgcaaag

SEQ ID NO: 690727 - DNA, 25 bp, Rattus norvegicus
tttcctctgctcacattacttttat

SEQ ID NO: 690728 - DNA, 25 bp, Rattus norvegicus
tttcctctgctctcattacttttat

SEQ ID NO: 690729 - DNA, 25 bp, Rattus norvegicus
tttcctctggaaagcgcatctgtgt

SEQ ID NO: 690730 - DNA, 25 bp, Rattus norvegicus
tttcctctggaatgcgcatctgtgt

SEQ ID NO: 690731 - DNA, 25 bp, Rattus norvegicus
tttcctctggctaggctatatcaat

SEQ ID NO: 690732 - DNA, 25 bp, Rattus norvegicus
tttcctctggcttggctatatcaat

SEQ ID NO: 690733 - DNA, 25 bp, Rattus norvegicus
tttcctctgggtagatagcaccata

SEQ ID NO: 690734 - DNA, 25 bp, Rattus norvegicus
tttcctctgggttgatagcaccata

SEQ ID NO: 690735 - DNA, 25 bp, Rattus norvegicus
tttcctctggtcagcatccatgaag

SEQ ID NO: 690736 - DNA, 25 bp, Rattus norvegicus
tttcctctggtctgcatccatgaag

SEQ ID NO: 690737 - DNA, 25 bp, Rattus norvegicus
tttcctctgttgactctgcaagatt

SEQ ID NO: 690738 - DNA, 25 bp, Rattus norvegicus
tttcctctgttgtctctgcaagatt

SEQ ID NO: 690739 - DNA, 25 bp, Rattus norvegicus
tttcctcttccactatcattgtgca

SEQ ID NO: 690740 - DNA, 25 bp, Rattus norvegicus
tttcctcttccactttgagcttgga

SEQ ID NO: 690741 - DNA, 25 bp, Rattus norvegicus
tttcctcttccagtatcattgtgca

SEQ ID NO: 690742 - DNA, 25 bp, Rattus norvegicus
tttcctcttccagtttgagcttgga

SEQ ID NO: 690743 - DNA, 25 bp, Rattus norvegicus
tttcctcttcctatgaaaatgcgga

SEQ ID NO: 690744 - DNA, 25 bp, Rattus norvegicus
tttcctcttcctcaagtacagcaga

SEQ ID NO: 690745 - DNA, 25 bp, Rattus norvegicus
tttcctcttcctgaagtacagcaga

SEQ ID NO: 690746 - DNA, 25 bp, Rattus norvegicus
tttcctcttcctttgaaaatgcgga

SEQ ID NO: 690747 - DNA, 25 bp, Rattus norvegicus
tttcctcttctgacaacctgggaga

SEQ ID NO: 690748 - DNA, 25 bp, Rattus norvegicus
tttcctcttctgtcaacctgggaga

SEQ ID NO: 690749 - DNA, 25 bp, Rattus norvegicus
tttcctcttggacctgttgtgcaga

SEQ ID NO: 690750 - DNA, 25 bp, Rattus norvegicus
tttcctcttggagctgttgtgcaga

SEQ ID NO: 690751 - DNA, 25 bp, Rattus norvegicus
tttcctcttggtaacactgttacag

SEQ ID NO: 690752 - DNA, 25 bp, Rattus norvegicus
tttcctcttggttacactgttacag

SEQ ID NO: 690753 - DNA, 25 bp, Rattus norvegicus
tttcctctttaccagtgcctgtgga

SEQ ID NO: 690754 - DNA, 25 bp, Rattus norvegicus
tttcctctttacgagtgcctgtgga

SEQ ID NO: 690755 - DNA, 25 bp, Rattus norvegicus
tttcctctttatcacatctgcactg

SEQ ID NO: 690756 - DNA, 25 bp, Rattus norvegicus
tttcctctttatgacatctgcactg

SEQ ID NO: 690757 - DNA, 25 bp, Rattus norvegicus
tttcctcttttaagcagagtctgaa

SEQ ID NO: 690758 - DNA, 25 bp, Rattus norvegicus
tttcctcttttatgcagagtctgaa

SEQ ID NO: 690759 - DNA, 25 bp, Rattus norvegicus
tttcctgaacctagactctctgggt

SEQ ID NO: 690760 - DNA, 25 bp, Rattus norvegicus
tttcctgaaccttgactctctgggt

SEQ ID NO: 690761 - DNA, 25 bp, Rattus norvegicus
tttcctgaccagaccattaagactt

SEQ ID NO: 690762 - DNA, 25 bp, Rattus norvegicus
tttcctgaccagtccattaagactt

SEQ ID NO: 690763 - DNA, 25 bp, Rattus norvegicus
tttcctgacctaattttcattatga

SEQ ID NO: 690764 - DNA, 25 bp, Rattus norvegicus
tttcctgacctatttttcattatga

SEQ ID NO: 690765 - DNA, 25 bp, Rattus norvegicus
tttcctgacctgatttgaggtccca

SEQ ID NO: 690766 - DNA, 25 bp, Rattus norvegicus
tttcctgacctgttttgaggtccca

SEQ ID NO: 690767 - DNA, 25 bp, Rattus norvegicus
tttcctgactctcttttcccatctt

SEQ ID NO: 690768 - DNA, 25 bp, Rattus norvegicus
tttcctgactctgttttcccatctt

SEQ ID NO: 690769 - DNA, 25 bp, Rattus norvegicus
tttcctgactgactggctgtacaac

SEQ ID NO: 690770 - DNA, 25 bp, Rattus norvegicus
tttcctgactgagtggctgtacaac

SEQ ID NO: 690771 - DNA, 25 bp, Rattus norvegicus
tttcctgactgcctgagcacatgag

SEQ ID NO: 690772 - DNA, 25 bp, Rattus norvegicus
tttcctgactgcgtgagcacatgag

SEQ ID NO: 690773 - DNA, 25 bp, Rattus norvegicus
tttcctgacttcacaatcatcttca

SEQ ID NO: 690774 - DNA, 25 bp, Rattus norvegicus
tttcctgacttctcaatcatcttca

SEQ ID NO: 690775 - DNA, 25 bp, Rattus norvegicus
tttcctgagcagaaatagccacttc

SEQ ID NO: 690776 - DNA, 25 bp, Rattus norvegicus
tttcctgagcagtaatagccacttc

SEQ ID NO: 690777 - DNA, 25 bp, Rattus norvegicus
tttcctgagccaacccgagggtgca

SEQ ID NO: 690778 - DNA, 25 bp, Rattus norvegicus
tttcctgagccatcccgagggtgca

SEQ ID NO: 690779 - DNA, 25 bp, Rattus norvegicus
tttcctgaggagaagcgcgggtccc

SEQ ID NO: 690780 - DNA, 25 bp, Rattus norvegicus
tttcctgaggagtagcgcgggtccc

SEQ ID NO: 690781 - DNA, 25 bp, Rattus norvegicus
tttcctgagggccatacacgacatg

SEQ ID NO: 690782 - DNA, 25 bp, Rattus norvegicus
tttcctgagggcgatacacgacatg

SEQ ID NO: 690783 - DNA, 25 bp, Rattus norvegicus
tttcctgagtgtcggcagacagtct

SEQ ID NO: 690784 - DNA, 25 bp, Rattus norvegicus
tttcctgagtgtgggcagacagtct

SEQ ID NO: 690785 - DNA, 25 bp, Rattus norvegicus
tttcctgagttcctatacccagagt

SEQ ID NO: 690786 - DNA, 25 bp, Rattus norvegicus
tttcctgagttcgtatacccagagt

SEQ ID NO: 690787 - DNA, 25 bp, Rattus norvegicus
tttcctgataaactactctgcttat

SEQ ID NO: 690788 - DNA, 25 bp, Rattus norvegicus
tttcctgataaagtactctgcttat

SEQ ID NO: 690789 - DNA, 25 bp, Rattus norvegicus
tttcctgcactaactgtcaggcata

SEQ ID NO: 690790 - DNA, 25 bp, Rattus norvegicus
tttcctgcactatctgtcaggcata

SEQ ID NO: 690791 - DNA, 25 bp, Rattus norvegicus
tttcctgcagaaattgccatgtact

SEQ ID NO: 690792 - DNA, 25 bp, Rattus norvegicus
tttcctgcagaatttgccatgtact

SEQ ID NO: 690793 - DNA, 25 bp, Rattus norvegicus
tttcctgcagttctcggctgtcttg

SEQ ID NO: 690794 - DNA, 25 bp, Rattus norvegicus
tttcctgcagttgtcggctgtcttg

SEQ ID NO: 690795 - DNA, 25 bp, Rattus norvegicus
tttcctgcattcatcgaactttgtt

SEQ ID NO: 690796 - DNA, 25 bp, Rattus norvegicus
tttcctgcattcttcgaactttgtt

SEQ ID NO: 690797 - DNA, 25 bp, Rattus norvegicus
tttcctgccaccctcctagtattga

SEQ ID NO: 690798 - DNA, 25 bp, Rattus norvegicus
tttcctgccaccgtcctagtattga

SEQ ID NO: 690799 - DNA, 25 bp, Rattus norvegicus
tttcctgcccacagaattagagcta

SEQ ID NO: 690800 - DNA, 25 bp, Rattus norvegicus
tttcctgcccactgaattagagcta

SEQ ID NO: 690801 - DNA, 25 bp, Rattus norvegicus
tttcctgccctgatggaccaaagtt

SEQ ID NO: 690802 - DNA, 25 bp, Rattus norvegicus
tttcctgccctgttggaccaaagtt

SEQ ID NO: 690803 - DNA, 25 bp, Rattus norvegicus
tttcctgccgtgacagaatcatcag

SEQ ID NO: 690804 - DNA, 25 bp, Rattus norvegicus
tttcctgccgtgtcagaatcatcag

SEQ ID NO: 690805 - DNA, 25 bp, Rattus norvegicus
tttcctgcctcaagagctggcttta

SEQ ID NO: 690806 - DNA, 25 bp, Rattus norvegicus
tttcctgcctcatgagctggcttta

SEQ ID NO: 690807 - DNA, 25 bp, Rattus norvegicus
tttcctgccttcaacatagttttca

SEQ ID NO: 690808 - DNA, 25 bp, Rattus norvegicus
tttcctgccttctacatagttttca

SEQ ID NO: 690809 - DNA, 25 bp, Rattus norvegicus
tttcctgcctttcgcttagaaccag

SEQ ID NO: 690810 - DNA, 25 bp, Rattus norvegicus
tttcctgcctttggcttagaaccag

SEQ ID NO: 690811 - DNA, 25 bp, Rattus norvegicus
tttcctgcgcctcacctggattgtg

SEQ ID NO: 690812 - DNA, 25 bp, Rattus norvegicus
tttcctgcgcctgacctggattgtg

SEQ ID NO: 690813 - DNA, 25 bp, Rattus norvegicus
tttcctgctcatcactcacagtgta

SEQ ID NO: 690814 - DNA, 25 bp, Rattus norvegicus
tttcctgctcatgactcacagtgta

SEQ ID NO: 690815 - DNA, 25 bp, Rattus norvegicus
tttcctgctctacacagaactttgg

SEQ ID NO: 690816 - DNA, 25 bp, Rattus norvegicus
tttcctgctctagacagaactttgg

SEQ ID NO: 690817 - DNA, 25 bp, Rattus norvegicus
tttcctgcttagaggcactgacatt

SEQ ID NO: 690818 - DNA, 25 bp, Rattus norvegicus
tttcctgcttagtggcactgacatt

SEQ ID NO: 690819 - DNA, 25 bp, Rattus norvegicus
tttcctgcttcaaagtcttcagcca

SEQ ID NO: 690820 - DNA, 25 bp, Rattus norvegicus
tttcctgcttcatagtcttcagcca

SEQ ID NO: 690821 - DNA, 25 bp, Rattus norvegicus
tttcctggaaaccagcatgcttcat

SEQ ID NO: 690822 - DNA, 25 bp, Rattus norvegicus
tttcctggaaacgagcatgcttcat

SEQ ID NO: 690823 - DNA, 25 bp, Rattus norvegicus
tttcctggaactcacactggccgaa

SEQ ID NO: 690824 - DNA, 25 bp, Rattus norvegicus
tttcctggaactgacactggccgaa

SEQ ID NO: 690825 - DNA, 25 bp, Rattus norvegicus
tttcctggaagcaacacaccctaag

SEQ ID NO: 690826 - DNA, 25 bp, Rattus norvegicus
tttcctggaagctacacaccctaag

SEQ ID NO: 690827 - DNA, 25 bp, Rattus norvegicus
tttcctggaattcactcggtaagta

SEQ ID NO: 690828 - DNA, 25 bp, Rattus norvegicus
tttcctggaattgactcggtaagta

SEQ ID NO: 690829 - DNA, 25 bp, Rattus norvegicus
tttcctggacacagtcacctaatga

SEQ ID NO: 690830 - DNA, 25 bp, Rattus norvegicus
tttcctggacactgtcacctaatga

SEQ ID NO: 690831 - DNA, 25 bp, Rattus norvegicus
tttcctggacctatgtgaaccacag

SEQ ID NO: 690832 - DNA, 25 bp, Rattus norvegicus
tttcctggacctttgtgaaccacag

SEQ ID NO: 690833 - DNA, 25 bp, Rattus norvegicus
tttcctggactcattgagtgtggca

SEQ ID NO: 690834 - DNA, 25 bp, Rattus norvegicus
tttcctggactctttgagtgtggca

SEQ ID NO: 690835 - DNA, 25 bp, Rattus norvegicus
tttcctggagctccgaaatgaaaat

SEQ ID NO: 690836 - DNA, 25 bp, Rattus norvegicus
tttcctggagctgcgaaatgaaaat

SEQ ID NO: 690837 - DNA, 25 bp, Rattus norvegicus
tttcctggaggaaatgccccaactt

SEQ ID NO: 690838 - DNA, 25 bp, Rattus norvegicus
tttcctggaggatatgccccaactt

SEQ ID NO: 690839 - DNA, 25 bp, Rattus norvegicus
tttcctggattacctgcaagagttc

SEQ ID NO: 690840 - DNA, 25 bp, Rattus norvegicus
tttcctggattagctgcaagagttc

SEQ ID NO: 690841 - DNA, 25 bp, Rattus norvegicus
tttcctggcacacacactattttta

SEQ ID NO: 690842 - DNA, 25 bp, Rattus norvegicus
tttcctggcacagacactattttta

SEQ ID NO: 690843 - DNA, 25 bp, Rattus norvegicus
tttcctggccaacaggtctacatgg

SEQ ID NO: 690844 - DNA, 25 bp, Rattus norvegicus
tttcctggccaagaggtctacatgg

SEQ ID NO: 690845 - DNA, 25 bp, Rattus norvegicus
tttcctggctggagcgttcgtggct

SEQ ID NO: 690846 - DNA, 25 bp, Rattus norvegicus
tttcctggctggtgcgttcgtggct

SEQ ID NO: 690847 - DNA, 25 bp, Rattus norvegicus
tttcctgggaagaccgttcaagcct

SEQ ID NO: 690848 - DNA, 25 bp, Rattus norvegicus
tttcctgggaagtccgttcaagcct

SEQ ID NO: 690849 - DNA, 25 bp, Rattus norvegicus
tttcctgggccaataccaagtagtt

SEQ ID NO: 690850 - DNA, 25 bp, Rattus norvegicus
tttcctgggccattaccaagtagtt

SEQ ID NO: 690851 - DNA, 25 bp, Rattus norvegicus
tttcctgggcgccaattcttcactt

SEQ ID NO: 690852 - DNA, 25 bp, Rattus norvegicus
tttcctgggcgcgaattcttcactt

SEQ ID NO: 690853 - DNA, 25 bp, Rattus norvegicus
tttcctggtctcactggtgtaaata

SEQ ID NO: 690854 - DNA, 25 bp, Rattus norvegicus
tttcctggtctctctggtgtaaata

SEQ ID NO: 690855 - DNA, 25 bp, Rattus norvegicus
tttcctggtgatccctcaggtggac

SEQ ID NO: 690856 - DNA, 25 bp, Rattus norvegicus
tttcctggtgatgcctcaggtggac

SEQ ID NO: 690857 - DNA, 25 bp, Rattus norvegicus
tttcctggtggaagagactttctta

SEQ ID NO: 690858 - DNA, 25 bp, Rattus norvegicus
tttcctggtggatgagactttctta

SEQ ID NO: 690859 - DNA, 25 bp, Rattus norvegicus
tttcctggtgttatgtgtttctcta

SEQ ID NO: 690860 - DNA, 25 bp, Rattus norvegicus
tttcctggtgttttgtgtttctcta

SEQ ID NO: 690861 - DNA, 25 bp, Rattus norvegicus
tttcctggttccaagcaaagactgc

SEQ ID NO: 690862 - DNA, 25 bp, Rattus norvegicus
tttcctggttcctagcaaagactgc

SEQ ID NO: 690863 - DNA, 25 bp, Rattus norvegicus
tttcctggttggagggacagcccca

SEQ ID NO: 690864 - DNA, 25 bp, Rattus norvegicus
tttcctggttggtgggacagcccca

SEQ ID NO: 690865 - DNA, 25 bp, Rattus norvegicus
tttcctggttttaccattcatgtta

SEQ ID NO: 690866 - DNA, 25 bp, Rattus norvegicus
tttcctggtttttccattcatgtta

SEQ ID NO: 690867 - DNA, 25 bp, Rattus norvegicus
tttcctgtacaactctccatttcct

SEQ ID NO: 690868 - DNA, 25 bp, Rattus norvegicus
tttcctgtacaagtctccatttcct

SEQ ID NO: 690869 - DNA, 25 bp, Rattus norvegicus
tttcctgtactgaaggcctgagctt

SEQ ID NO: 690870 - DNA, 25 bp, Rattus norvegicus
tttcctgtactgtaggcctgagctt

SEQ ID NO: 690871 - DNA, 25 bp, Rattus norvegicus
tttcctgtagacctcgagttgctcc

SEQ ID NO: 690872 - DNA, 25 bp, Rattus norvegicus
tttcctgtagacgtcgagttgctcc

SEQ ID NO: 690873 - DNA, 25 bp, Rattus norvegicus
tttcctgtaggacccaaatgattgt

SEQ ID NO: 690874 - DNA, 25 bp, Rattus norvegicus
tttcctgtaggagccaaatgattgt

SEQ ID NO: 690875 - DNA, 25 bp, Rattus norvegicus
tttcctgtagtgctacgcgccagaa

SEQ ID NO: 690876 - DNA, 25 bp, Rattus norvegicus
tttcctgtagtggtacgcgccagaa

SEQ ID NO: 690877 - DNA, 25 bp, Rattus norvegicus
tttcctgtatatagccatggtttca

SEQ ID NO: 690878 - DNA, 25 bp, Rattus norvegicus
tttcctgtatattgccatggtttca

SEQ ID NO: 690879 - DNA, 25 bp, Rattus norvegicus
tttcctgtcactaccgtcttcaatt

SEQ ID NO: 690880 - DNA, 25 bp, Rattus norvegicus
tttcctgtcacttccgtcttcaatt

SEQ ID NO: 690881 - DNA, 25 bp, Rattus norvegicus
tttcctgtcagtagcaaacgaagtt

SEQ ID NO: 690882 - DNA, 25 bp, Rattus norvegicus
tttcctgtcagttgcaaacgaagtt

SEQ ID NO: 690883 - DNA, 25 bp, Rattus norvegicus
tttcctgtcctcatgagtatttcta

SEQ ID NO: 690884 - DNA, 25 bp, Rattus norvegicus
tttcctgtcctcttgagtatttcta

SEQ ID NO: 690885 - DNA, 25 bp, Rattus norvegicus
tttcctgtcttgaagcccgtttcaa

SEQ ID NO: 690886 - DNA, 25 bp, Rattus norvegicus
tttcctgtcttgtagcccgtttcaa

SEQ ID NO: 690887 - DNA, 25 bp, Rattus norvegicus
tttcctgtgacactatctttaactg

SEQ ID NO: 690888 - DNA, 25 bp, Rattus norvegicus
tttcctgtgacagtatctttaactg

SEQ ID NO: 690889 - DNA, 25 bp, Rattus norvegicus
tttcctgtgatcagcctacctgatg

SEQ ID NO: 690890 - DNA, 25 bp, Rattus norvegicus
tttcctgtgatctgcctacctgatg

SEQ ID NO: 690891 - DNA, 25 bp, Rattus norvegicus
tttcctgtgctcatgacagtgtgtt

SEQ ID NO: 690892 - DNA, 25 bp, Rattus norvegicus
tttcctgtgctcttgacagtgtgtt

SEQ ID NO: 690893 - DNA, 25 bp, Rattus norvegicus
tttcctgtgcttatagtatgtcttt

SEQ ID NO: 690894 - DNA, 25 bp, Rattus norvegicus
tttcctgtgcttttagtatgtcttt

SEQ ID NO: 690895 - DNA, 25 bp, Rattus norvegicus
tttcctgtggcaataaaactgtctt

SEQ ID NO: 690896 - DNA, 25 bp, Rattus norvegicus
tttcctgtggcattaaaactgtctt

SEQ ID NO: 690897 - DNA, 25 bp, Rattus norvegicus
tttcctgtggccagcctctccgatg

SEQ ID NO: 690898 - DNA, 25 bp, Rattus norvegicus
tttcctgtggcctgcctctccgatg

SEQ ID NO: 690899 - DNA, 25 bp, Rattus norvegicus
tttcctgtggtgctctcgagagatt

SEQ ID NO: 690900 - DNA, 25 bp, Rattus norvegicus
tttcctgtggtggtctcgagagatt

SEQ ID NO: 690901 - DNA, 25 bp, Rattus norvegicus
tttcctgtgtggcagtcactgtagt

SEQ ID NO: 690902 - DNA, 25 bp, Rattus norvegicus
tttcctgtgtgggagtcactgtagt

SEQ ID NO: 690903 - DNA, 25 bp, Rattus norvegicus
tttcctgttatgaacctagtgttag

SEQ ID NO: 690904 - DNA, 25 bp, Rattus norvegicus
tttcctgttatgtacctagtgttag

SEQ ID NO: 690905 - DNA, 25 bp, Rattus norvegicus
tttcctgttcaaattttgccttgtt

SEQ ID NO: 690906 - DNA, 25 bp, Rattus norvegicus
tttcctgttcaatttttgccttgtt

SEQ ID NO: 690907 - DNA, 25 bp, Rattus norvegicus
tttcctgttcaccacgtattatctg

SEQ ID NO: 690908 - DNA, 25 bp, Rattus norvegicus
tttcctgttcacgacgtattatctg

SEQ ID NO: 690909 - DNA, 25 bp, Rattus norvegicus
tttcctgttcagctgtgcaaggcca

SEQ ID NO: 690910 - DNA, 25 bp, Rattus norvegicus
tttcctgttcaggtgtgcaaggcca

SEQ ID NO: 690911 - DNA, 25 bp, Rattus norvegicus
tttcctgttctgatgtgggactcgt

SEQ ID NO: 690912 - DNA, 25 bp, Rattus norvegicus
tttcctgttctgctagaggctctct

SEQ ID NO: 690913 - DNA, 25 bp, Rattus norvegicus
tttcctgttctggtagaggctctct

SEQ ID NO: 690914 - DNA, 25 bp, Rattus norvegicus
tttcctgttctgttgtgggactcgt

SEQ ID NO: 690915 - DNA, 25 bp, Rattus norvegicus
tttcctgttgctcgaacacgggcac

SEQ ID NO: 690916 - DNA, 25 bp, Rattus norvegicus
tttcctgttgctggaacacgggcac

SEQ ID NO: 690917 - DNA, 25 bp, Rattus norvegicus
tttcctgttgtaacttctggtgtac

SEQ ID NO: 690918 - DNA, 25 bp, Rattus norvegicus
tttcctgttgtatcttctggtgtac

SEQ ID NO: 690919 - DNA, 25 bp, Rattus norvegicus
tttcctgttttaatgcaatccctta

SEQ ID NO: 690920 - DNA, 25 bp, Rattus norvegicus
tttcctgttttattgcaatccctta

SEQ ID NO: 690921 - DNA, 25 bp, Rattus norvegicus
tttccttaatcacagttgctaccca

SEQ ID NO: 690922 - DNA, 25 bp, Rattus norvegicus
tttccttaatcagagttgctaccca

SEQ ID NO: 690923 - DNA, 25 bp, Rattus norvegicus
tttccttacaagactttcttccgag

SEQ ID NO: 690924 - DNA, 25 bp, Rattus norvegicus
tttccttacaagtctttcttccgag

SEQ ID NO: 690925 - DNA, 25 bp, Rattus norvegicus
tttccttacttcactgcattcgttt

SEQ ID NO: 690926 - DNA, 25 bp, Rattus norvegicus
tttccttacttctctgcattcgttt

SEQ ID NO: 690927 - DNA, 25 bp, Rattus norvegicus
tttccttactttccggcctgtgagc

SEQ ID NO: 690928 - DNA, 25 bp, Rattus norvegicus
tttccttactttgcggcctgtgagc

SEQ ID NO: 690929 - DNA, 25 bp, Rattus norvegicus
tttccttagaagctcctgtgctctc

SEQ ID NO: 690930 - DNA, 25 bp, Rattus norvegicus
tttccttagaaggtcctgtgctctc

SEQ ID NO: 690931 - DNA, 25 bp, Rattus norvegicus
tttccttaggagatgagcccttctc

SEQ ID NO: 690932 - DNA, 25 bp, Rattus norvegicus
tttccttaggagttgagcccttctc

SEQ ID NO: 690933 - DNA, 25 bp, Rattus norvegicus
tttccttataggaaattcctcacac

SEQ ID NO: 690934 - DNA, 25 bp, Rattus norvegicus
tttccttataggtaattcctcacac

SEQ ID NO: 690935 - DNA, 25 bp, Rattus norvegicus
tttccttatggaagcacagtcgtgt

SEQ ID NO: 690936 - DNA, 25 bp, Rattus norvegicus
tttccttatggatgcacagtcgtgt

SEQ ID NO: 690937 - DNA, 25 bp, Rattus norvegicus
tttccttattcacttcatgtctcag

SEQ ID NO: 690938 - DNA, 25 bp, Rattus norvegicus
tttccttattcagttcatgtctcag

SEQ ID NO: 690939 - DNA, 25 bp, Rattus norvegicus
tttccttcagagcttgagctttgtg

SEQ ID NO: 690940 - DNA, 25 bp, Rattus norvegicus
tttccttcagaggttgagctttgtg

SEQ ID NO: 690941 - DNA, 25 bp, Rattus norvegicus
tttccttcagtcagtgagctcagca

SEQ ID NO: 690942 - DNA, 25 bp, Rattus norvegicus
tttccttcagtctgtgagctcagca

SEQ ID NO: 690943 - DNA, 25 bp, Rattus norvegicus
tttccttcagtgacagttggtgttc

SEQ ID NO: 690944 - DNA, 25 bp, Rattus norvegicus
tttccttcagtgtcagttggtgttc

SEQ ID NO: 690945 - DNA, 25 bp, Rattus norvegicus
tttccttcatctacctcctttagtg

SEQ ID NO: 690946 - DNA, 25 bp, Rattus norvegicus
tttccttcatcttcctcctttagtg

SEQ ID NO: 690947 - DNA, 25 bp, Rattus norvegicus
tttccttccaagaagacagacctgt

SEQ ID NO: 690948 - DNA, 25 bp, Rattus norvegicus
tttccttccaagatgaaagcagtga

SEQ ID NO: 690949 - DNA, 25 bp, Rattus norvegicus
tttccttccaagtagacagacctgt

SEQ ID NO: 690950 - DNA, 25 bp, Rattus norvegicus
tttccttccaagttgaaagcagtga

SEQ ID NO: 690951 - DNA, 25 bp, Rattus norvegicus
tttccttccactattgggtcataag

SEQ ID NO: 690952 - DNA, 25 bp, Rattus norvegicus
tttccttccacttttgggtcataag

SEQ ID NO: 690953 - DNA, 25 bp, Rattus norvegicus
tttccttcccagatgcattttacaa

SEQ ID NO: 690954 - DNA, 25 bp, Rattus norvegicus
tttccttcccagttgcattttacaa

SEQ ID NO: 690955 - DNA, 25 bp, Rattus norvegicus
tttccttccgatagtcagagcttgg

SEQ ID NO: 690956 - DNA, 25 bp, Rattus norvegicus
tttccttccgattgtcagagcttgg

SEQ ID NO: 690957 - DNA, 25 bp, Rattus norvegicus
tttccttcctcgagcagagctaggg

SEQ ID NO: 690958 - DNA, 25 bp, Rattus norvegicus
tttccttcctcgtgcagagctaggg

SEQ ID NO: 690959 - DNA, 25 bp, Rattus norvegicus
tttccttcctctccatttactaaat

SEQ ID NO: 690960 - DNA, 25 bp, Rattus norvegicus
tttccttcctctgcatttactaaat

SEQ ID NO: 690961 - DNA, 25 bp, Rattus norvegicus
tttccttccttaaaagctcctgtca

SEQ ID NO: 690962 - DNA, 25 bp, Rattus norvegicus
tttccttccttaatgggagcgtgtg

SEQ ID NO: 690963 - DNA, 25 bp, Rattus norvegicus
tttccttccttataagctcctgtca

SEQ ID NO: 690964 - DNA, 25 bp, Rattus norvegicus
tttccttccttattgggagcgtgtg

SEQ ID NO: 690965 - DNA, 25 bp, Rattus norvegicus
tttccttccttcatgctggagagca

SEQ ID NO: 690966 - DNA, 25 bp, Rattus norvegicus
tttccttccttcttgctggagagca

SEQ ID NO: 690967 - DNA, 25 bp, Rattus norvegicus
tttccttccttgacctagttggata

SEQ ID NO: 690968 - DNA, 25 bp, Rattus norvegicus
tttccttccttgtcctagttggata

SEQ ID NO: 690969 - DNA, 25 bp, Rattus norvegicus
tttccttcggagctctcgcgagagg

SEQ ID NO: 690970 - DNA, 25 bp, Rattus norvegicus
tttccttcggaggtctcgcgagagg

SEQ ID NO: 690971 - DNA, 25 bp, Rattus norvegicus
tttccttcggttaggtgactgggtg

SEQ ID NO: 690972 - DNA, 25 bp, Rattus norvegicus
tttccttcggtttggtgactgggtg

SEQ ID NO: 690973 - DNA, 25 bp, Rattus norvegicus
tttccttcgttgattgtagcacctc

SEQ ID NO: 690974 - DNA, 25 bp, Rattus norvegicus
tttccttcgttgtttgtagcacctc

SEQ ID NO: 690975 - DNA, 25 bp, Rattus norvegicus
tttccttctgaaatgtaaacccgag

SEQ ID NO: 690976 - DNA, 25 bp, Rattus norvegicus
tttccttctgaattgtaaacccgag

SEQ ID NO: 690977 - DNA, 25 bp, Rattus norvegicus
tttccttctgtaagccacactgaac

SEQ ID NO: 690978 - DNA, 25 bp, Rattus norvegicus
tttccttctgtatgccacactgaac

SEQ ID NO: 690979 - DNA, 25 bp, Rattus norvegicus
tttccttcttccaaatagtttcaga

SEQ ID NO: 690980 - DNA, 25 bp, Rattus norvegicus
tttccttcttcctaatagtttcaga

SEQ ID NO: 690981 - DNA, 25 bp, Rattus norvegicus
tttccttgaagaacctctggctgta

SEQ ID NO: 690982 - DNA, 25 bp, Rattus norvegicus
tttccttgaagatcctctggctgta

SEQ ID NO: 690983 - DNA, 25 bp, Rattus norvegicus
tttccttgaagtcagctgctaagca

SEQ ID NO: 690984 - DNA, 25 bp, Rattus norvegicus
tttccttgaagtgagctgctaagca

SEQ ID NO: 690985 - DNA, 25 bp, Rattus norvegicus
tttccttgacctattctggtttgtg

SEQ ID NO: 690986 - DNA, 25 bp, Rattus norvegicus
tttccttgaccttttctggtttgtg

SEQ ID NO: 690987 - DNA, 25 bp, Rattus norvegicus
tttccttgagctcttccaacttgaa

SEQ ID NO: 690988 - DNA, 25 bp, Rattus norvegicus
tttccttgagctgttccaacttgaa

SEQ ID NO: 690989 - DNA, 25 bp, Rattus norvegicus
tttccttgatctcgccttacattag

SEQ ID NO: 690990 - DNA, 25 bp, Rattus norvegicus
tttccttgatctggccttacattag

SEQ ID NO: 690991 - DNA, 25 bp, Rattus norvegicus
tttccttgatggatgcttaccagca

SEQ ID NO: 690992 - DNA, 25 bp, Rattus norvegicus
tttccttgatggttgcttaccagca

SEQ ID NO: 690993 - DNA, 25 bp, Rattus norvegicus
tttccttgcggcagctccagggatg

SEQ ID NO: 690994 - DNA, 25 bp, Rattus norvegicus
tttccttgcggctgctccagggatg

SEQ ID NO: 690995 - DNA, 25 bp, Rattus norvegicus
tttccttgctcaaccatggctgaag

SEQ ID NO: 690996 - DNA, 25 bp, Rattus norvegicus
tttccttgctcatccatggctgaag

SEQ ID NO: 690997 - DNA, 25 bp, Rattus norvegicus
tttccttgctttctaccatgtgttg

SEQ ID NO: 690998 - DNA, 25 bp, Rattus norvegicus
tttccttgctttgtaccatgtgttg

SEQ ID NO: 690999 - DNA, 25 bp, Rattus norvegicus
tttccttggagcatagagtgactat

SEQ ID NO: 691000 - DNA, 25 bp, Rattus norvegicus
tttccttggagcttagagtgactat

SEQ ID NO: 691001 - DNA, 25 bp, Rattus norvegicus
tttccttggtggcatggtaaccaca

SEQ ID NO: 691002 - DNA, 25 bp, Rattus norvegicus
tttccttggtgggatggtaaccaca

SEQ ID NO: 691003 - DNA, 25 bp, Rattus norvegicus
tttccttgtgaaagtaaagaccaca

SEQ ID NO: 691004 - DNA, 25 bp, Rattus norvegicus
tttccttgtgaatgtaaagaccaca

SEQ ID NO: 691005 - DNA, 25 bp, Rattus norvegicus
tttccttgtgttactttccttctca

SEQ ID NO: 691006 - DNA, 25 bp, Rattus norvegicus
tttccttgtgtttctttccttctca

SEQ ID NO: 691007 - DNA, 25 bp, Rattus norvegicus
tttccttgtttccttgtgagataaa

SEQ ID NO: 691008 - DNA, 25 bp, Rattus norvegicus
tttccttgtttcgttgtgagataaa

SEQ ID NO: 691009 - DNA, 25 bp, Rattus norvegicus
tttccttgttttactacctgtcctg

SEQ ID NO: 691010 - DNA, 25 bp, Rattus norvegicus
tttccttgtttttctacctgtcctg

SEQ ID NO: 691011 - DNA, 25 bp, Rattus norvegicus
tttcctttaactcctgtgaacccac

SEQ ID NO: 691012 - DNA, 25 bp, Rattus norvegicus
tttcctttaactgctgtgaacccac

SEQ ID NO: 691013 - DNA, 25 bp, Rattus norvegicus
tttcctttatttatgtagtgctgag

SEQ ID NO: 691014 - DNA, 25 bp, Rattus norvegicus
tttcctttatttttgtagtgctgag

SEQ ID NO: 691015 - DNA, 25 bp, Rattus norvegicus
tttcctttcaataaactgtcggctg

SEQ ID NO: 691016 - DNA, 25 bp, Rattus norvegicus
tttcctttcaattaactgtcggctg

SEQ ID NO: 691017 - DNA, 25 bp, Rattus norvegicus
tttcctttcaccatatagtcctcag

SEQ ID NO: 691018 - DNA, 25 bp, Rattus norvegicus
tttcctttcaccttatagtcctcag

SEQ ID NO: 691019 - DNA, 25 bp, Rattus norvegicus
tttcctttccacaaagttgaccctg

SEQ ID NO: 691020 - DNA, 25 bp, Rattus norvegicus
tttcctttccaccaacgacaaatcg

SEQ ID NO: 691021 - DNA, 25 bp, Rattus norvegicus
tttcctttccaccagatcaaactgt

SEQ ID NO: 691022 - DNA, 25 bp, Rattus norvegicus
tttcctttccacgaacgacaaatcg

SEQ ID NO: 691023 - DNA, 25 bp, Rattus norvegicus
tttcctttccacgagatcaaactgt

SEQ ID NO: 691024 - DNA, 25 bp, Rattus norvegicus
tttcctttccactaagttgaccctg

SEQ ID NO: 691025 - DNA, 25 bp, Rattus norvegicus
tttcctttccagacatttcaataaa

SEQ ID NO: 691026 - DNA, 25 bp, Rattus norvegicus
tttcctttccagtcatttcaataaa

SEQ ID NO: 691027 - DNA, 25 bp, Rattus norvegicus
tttcctttcctgattcggaagagca

SEQ ID NO: 691028 - DNA, 25 bp, Rattus norvegicus
tttcctttcctgtttcggaagagca

SEQ ID NO: 691029 - DNA, 25 bp, Rattus norvegicus
tttcctttcgtgctgccctacagaa

SEQ ID NO: 691030 - DNA, 25 bp, Rattus norvegicus
tttcctttcgtggtgccctacagaa

SEQ ID NO: 691031 - DNA, 25 bp, Rattus norvegicus
tttcctttctctcgaggcatcatgt

SEQ ID NO: 691032 - DNA, 25 bp, Rattus norvegicus
tttcctttctctggaggcatcatgt

SEQ ID NO: 691033 - DNA, 25 bp, Rattus norvegicus
tttcctttcttcagactccgtccaa

SEQ ID NO: 691034 - DNA, 25 bp, Rattus norvegicus
tttcctttcttctgactccgtccaa

SEQ ID NO: 691035 - DNA, 25 bp, Rattus norvegicus
tttcctttcttgatctgttgttgtt

SEQ ID NO: 691036 - DNA, 25 bp, Rattus norvegicus
tttcctttcttgttctgttgttgtt

SEQ ID NO: 691037 - DNA, 25 bp, Rattus norvegicus
tttcctttgaccatgtaggttccaa

SEQ ID NO: 691038 - DNA, 25 bp, Rattus norvegicus
tttcctttgaccttgtaggttccaa

SEQ ID NO: 691039 - DNA, 25 bp, Rattus norvegicus
tttcctttgcagagtcatcttgatt

SEQ ID NO: 691040 - DNA, 25 bp, Rattus norvegicus
tttcctttgcagtgtcatcttgatt

SEQ ID NO: 691041 - DNA, 25 bp, Rattus norvegicus
tttcctttgcatacatctctcaaac

SEQ ID NO: 691042 - DNA, 25 bp, Rattus norvegicus
tttcctttgcattcatctctcaaac

SEQ ID NO: 691043 - DNA, 25 bp, Rattus norvegicus
tttcctttgctcactctgctttgga

SEQ ID NO: 691044 - DNA, 25 bp, Rattus norvegicus
tttcctttgctctctctgctttgga

SEQ ID NO: 691045 - DNA, 25 bp, Rattus norvegicus
tttcctttgtcaaccttgtgttgat

SEQ ID NO: 691046 - DNA, 25 bp, Rattus norvegicus
tttcctttgtcatccttgtgttgat

SEQ ID NO: 691047 - DNA, 25 bp, Rattus norvegicus
tttcctttgtgtctggatgcccaat

SEQ ID NO: 691048 - DNA, 25 bp, Rattus norvegicus
tttcctttgtgtgtggatgcccaat

SEQ ID NO: 691049 - DNA, 25 bp, Rattus norvegicus
tttccttttaaactggtcatcaatg

SEQ ID NO: 691050 - DNA, 25 bp, Rattus norvegicus
tttccttttaaagtggtcatcaatg

SEQ ID NO: 691051 - DNA, 25 bp, Rattus norvegicus
tttccttttagcactgctggtcaga

SEQ ID NO: 691052 - DNA, 25 bp, Rattus norvegicus
tttccttttagctctgctggtcaga

SEQ ID NO: 691053 - DNA, 25 bp, Rattus norvegicus
tttccttttcatctcagttggcagc

SEQ ID NO: 691054 - DNA, 25 bp, Rattus norvegicus
tttccttttcatgtcagttggcagc

SEQ ID NO: 691055 - DNA, 25 bp, Rattus norvegicus
tttccttttgaaaacttgctgttga

SEQ ID NO: 691056 - DNA, 25 bp, Rattus norvegicus
tttccttttgaatacttgctgttga

SEQ ID NO: 691057 - DNA, 25 bp, Rattus norvegicus
tttccttttggcagcatccttagct

SEQ ID NO: 691058 - DNA, 25 bp, Rattus norvegicus
tttccttttggctgcatccttagct

SEQ ID NO: 691059 - DNA, 25 bp, Rattus norvegicus
tttccttttgtaattccttaagcat

SEQ ID NO: 691060 - DNA, 25 bp, Rattus norvegicus
tttccttttgtatttccttaagcat

SEQ ID NO: 691061 - DNA, 25 bp, Rattus norvegicus
tttccttttgtcactaggctcaaat

SEQ ID NO: 691062 - DNA, 25 bp, Rattus norvegicus
tttccttttgtctctaggctcaaat

SEQ ID NO: 691063 - DNA, 25 bp, Rattus norvegicus
tttccttttgtgctcttttgtacat

SEQ ID NO: 691064 - DNA, 25 bp, Rattus norvegicus
tttccttttgtggtcttttgtacat

SEQ ID NO: 691065 - DNA, 25 bp, Rattus norvegicus
tttcctttttatactgagggcccat

SEQ ID NO: 691066 - DNA, 25 bp, Rattus norvegicus
tttcctttttattctgagggcccat

SEQ ID NO: 691067 - DNA, 25 bp, Rattus norvegicus
tttcctttttccctagagagccatc

SEQ ID NO: 691068 - DNA, 25 bp, Rattus norvegicus
tttcctttttccgtagagagccatc

SEQ ID NO: 691069 - DNA, 25 bp, Rattus norvegicus
tttcctttttctcttgatgtggaca

SEQ ID NO: 691070 - DNA, 25 bp, Rattus norvegicus
tttcctttttctgttgatgtggaca

SEQ ID NO: 691071 - DNA, 25 bp, Rattus norvegicus
tttcctttttggctatcttgttcag

SEQ ID NO: 691072 - DNA, 25 bp, Rattus norvegicus
tttcctttttgggtatcttgttcag

SEQ ID NO: 691073 - DNA, 25 bp, Rattus norvegicus
tttcgaaaccttcttctgcatcagc

SEQ ID NO: 691074 - DNA, 25 bp, Rattus norvegicus
tttcgaaaccttgttctgcatcagc

SEQ ID NO: 691075 - DNA, 25 bp, Rattus norvegicus
tttcgaaactttccaggtgatcaat

SEQ ID NO: 691076 - DNA, 25 bp, Rattus norvegicus
tttcgaaactttgcaggtgatcaat

SEQ ID NO: 691077 - DNA, 25 bp, Rattus norvegicus
tttcgaaagcctcccctcagtaata

SEQ ID NO: 691078 - DNA, 25 bp, Rattus norvegicus
tttcgaaagcctgccctcagtaata

SEQ ID NO: 691079 - DNA, 25 bp, Rattus norvegicus
tttcgaacagaccaagtccaccggg

SEQ ID NO: 691080 - DNA, 25 bp, Rattus norvegicus
tttcgaacagacgaagtccaccggg

SEQ ID NO: 691081 - DNA, 25 bp, Rattus norvegicus
tttcgaacatttcccatctcttgct

SEQ ID NO: 691082 - DNA, 25 bp, Rattus norvegicus
tttcgaacatttgccatctcttgct

SEQ ID NO: 691083 - DNA, 25 bp, Rattus norvegicus
tttcgaaggagcctcggaaccgtgc

SEQ ID NO: 691084 - DNA, 25 bp, Rattus norvegicus
tttcgaaggagcgtcggaaccgtgc

SEQ ID NO: 691085 - DNA, 25 bp, Rattus norvegicus
tttcgaagtctaatcttggttccta

SEQ ID NO: 691086 - DNA, 25 bp, Rattus norvegicus
tttcgaagtctattcttggttccta

SEQ ID NO: 691087 - DNA, 25 bp, Rattus norvegicus
tttcgaatacatccagagcgtgctg

SEQ ID NO: 691088 - DNA, 25 bp, Rattus norvegicus
tttcgaatacatgcagagcgtgctg

SEQ ID NO: 691089 - DNA, 25 bp, Rattus norvegicus
tttcgaatgcacagatggatcttca

SEQ ID NO: 691090 - DNA, 25 bp, Rattus norvegicus
tttcgaatgcactgatggatcttca

SEQ ID NO: 691091 - DNA, 25 bp, Rattus norvegicus
tttcgaccgagtacgggatccagag

SEQ ID NO: 691092 - DNA, 25 bp, Rattus norvegicus
tttcgaccgagttcgggatccagag

SEQ ID NO: 691093 - DNA, 25 bp, Rattus norvegicus
tttcgactatggaaaacagccggga

SEQ ID NO: 691094 - DNA, 25 bp, Rattus norvegicus
tttcgactatggtaaacagccggga

SEQ ID NO: 691095 - DNA, 25 bp, Rattus norvegicus
tttcgactgcttccagggactattt

SEQ ID NO: 691096 - DNA, 25 bp, Rattus norvegicus
tttcgactgcttgcagggactattt

SEQ ID NO: 691097 - DNA, 25 bp, Rattus norvegicus
tttcgagaacccagtgctgcagcag

SEQ ID NO: 691098 - DNA, 25 bp, Rattus norvegicus
tttcgagaaccctgtgctgcagcag

SEQ ID NO: 691099 - DNA, 25 bp, Rattus norvegicus
tttcgagaatgcagatactttttaa

SEQ ID NO: 691100 - DNA, 25 bp, Rattus norvegicus
tttcgagaatgctgatactttttaa

SEQ ID NO: 691101 - DNA, 25 bp, Rattus norvegicus
tttcgagactgcagcttctctggtg

SEQ ID NO: 691102 - DNA, 25 bp, Rattus norvegicus
tttcgagactgctgcttctctggtg

SEQ ID NO: 691103 - DNA, 25 bp, Rattus norvegicus
tttcgaggcttcctggtccagggct

SEQ ID NO: 691104 - DNA, 25 bp, Rattus norvegicus
tttcgaggcttcgtggtccagggct

SEQ ID NO: 691105 - DNA, 25 bp, Rattus norvegicus
tttcgaggtcctcaagtcttcttga

SEQ ID NO: 691106 - DNA, 25 bp, Rattus norvegicus
tttcgaggtcctgaagtcttcttga

SEQ ID NO: 691107 - DNA, 25 bp, Rattus norvegicus
tttcgagtacgtcaccagccataaa

SEQ ID NO: 691108 - DNA, 25 bp, Rattus norvegicus
tttcgagtacgtgaccagccataaa

SEQ ID NO: 691109 - DNA, 25 bp, Rattus norvegicus
tttcgagtgtacatttaagactctt

SEQ ID NO: 691110 - DNA, 25 bp, Rattus norvegicus
tttcgagtgtacttttaagactctt

SEQ ID NO: 691111 - DNA, 25 bp, Rattus norvegicus
tttcgatcatgtcgctgactgcctg

SEQ ID NO: 691112 - DNA, 25 bp, Rattus norvegicus
tttcgatcatgtggctgactgcctg

SEQ ID NO: 691113 - DNA, 25 bp, Rattus norvegicus
tttcgatcctcgacaggtgcaggtc

SEQ ID NO: 691114 - DNA, 25 bp, Rattus norvegicus
tttcgatcctcgtcaggtgcaggtc

SEQ ID NO: 691115 - DNA, 25 bp, Rattus norvegicus
tttcgatcggcccagcctctgtcaa

SEQ ID NO: 691116 - DNA, 25 bp, Rattus norvegicus
tttcgatcggccgagcctctgtcaa

SEQ ID NO: 691117 - DNA, 25 bp, Rattus norvegicus
tttcgatctggaagacacgatggac

SEQ ID NO: 691118 - DNA, 25 bp, Rattus norvegicus
tttcgatctggatgacacgatggac

SEQ ID NO: 691119 - DNA, 25 bp, Rattus norvegicus
tttcgatcttcaaaacggacaaact

SEQ ID NO: 691120 - DNA, 25 bp, Rattus norvegicus
tttcgatcttcataacggacaaact

SEQ ID NO: 691121 - DNA, 25 bp, Rattus norvegicus
tttcgatggcgaagactttgatgac

SEQ ID NO: 691122 - DNA, 25 bp, Rattus norvegicus
tttcgatggcgatgactttgatgac

SEQ ID NO: 691123 - DNA, 25 bp, Rattus norvegicus
tttcgatgtctcagtcgggacggaa

SEQ ID NO: 691124 - DNA, 25 bp, Rattus norvegicus
tttcgatgtctctgtcgggacggaa

SEQ ID NO: 691125 - DNA, 25 bp, Rattus norvegicus
tttcgcagacgccttggaggtcatc

SEQ ID NO: 691126 - DNA, 25 bp, Rattus norvegicus
tttcgcagacgcgttggaggtcatc

SEQ ID NO: 691127 - DNA, 25 bp, Rattus norvegicus
tttcgcagagccctcgttcagtcaa

SEQ ID NO: 691128 - DNA, 25 bp, Rattus norvegicus
tttcgcagagccgtcgttcagtcaa

SEQ ID NO: 691129 - DNA, 25 bp, Rattus norvegicus
tttcgcaggaggctacacacgcaat

SEQ ID NO: 691130 - DNA, 25 bp, Rattus norvegicus
tttcgcaggagggtacacacgcaat

SEQ ID NO: 691131 - DNA, 25 bp, Rattus norvegicus
tttcgcccagcactactgactttag

SEQ ID NO: 691132 - DNA, 25 bp, Rattus norvegicus
tttcgcccagcagtactgactttag

SEQ ID NO: 691133 - DNA, 25 bp, Rattus norvegicus
tttcgccgacagctgcagcgggcac

SEQ ID NO: 691134 - DNA, 25 bp, Rattus norvegicus
tttcgccgacaggtgcagcgggcac

SEQ ID NO: 691135 - DNA, 25 bp, Rattus norvegicus
tttcgccgcgctctagccggagctg

SEQ ID NO: 691136 - DNA, 25 bp, Rattus norvegicus
tttcgccgcgctgtagccggagctg

SEQ ID NO: 691137 - DNA, 25 bp, Rattus norvegicus
tttcgcctcccacaggaccaatgaa

SEQ ID NO: 691138 - DNA, 25 bp, Rattus norvegicus
tttcgcctcccagaggaccaatgaa

SEQ ID NO: 691139 - DNA, 25 bp, Rattus norvegicus
tttcgcctgcctatttgggccaagc

SEQ ID NO: 691140 - DNA, 25 bp, Rattus norvegicus
tttcgcctgcctttttgggccaagc

SEQ ID NO: 691141 - DNA, 25 bp, Rattus norvegicus
tttcgccttctcaggacttgcagcc

SEQ ID NO: 691142 - DNA, 25 bp, Rattus norvegicus
tttcgccttctctggacttgcagcc

SEQ ID NO: 691143 - DNA, 25 bp, Rattus norvegicus
tttcgctccttccatcagaagttgg

SEQ ID NO: 691144 - DNA, 25 bp, Rattus norvegicus
tttcgctccttcgatcagaagttgg

SEQ ID NO: 691145 - DNA, 25 bp, Rattus norvegicus
tttcgctgaacaactgggccagtct

SEQ ID NO: 691146 - DNA, 25 bp, Rattus norvegicus
tttcgctgaacatctgggccagtct

SEQ ID NO: 691147 - DNA, 25 bp, Rattus norvegicus
tttcgctgagcgagtgacgtcacta

SEQ ID NO: 691148 - DNA, 25 bp, Rattus norvegicus
tttcgctgagcgtgtgacgtcacta

SEQ ID NO: 691149 - DNA, 25 bp, Rattus norvegicus
tttcgctgcgccatctgtgggaaga

SEQ ID NO: 691150 - DNA, 25 bp, Rattus norvegicus
tttcgctgcgccttctgtgggaaga

SEQ ID NO: 691151 - DNA, 25 bp, Rattus norvegicus
tttcgctgctgaaatggaaccaata

SEQ ID NO: 691152 - DNA, 25 bp, Rattus norvegicus
tttcgctgctgatatggaaccaata

SEQ ID NO: 691153 - DNA, 25 bp, Rattus norvegicus
tttcgctgctgcaggctagcaccta

SEQ ID NO: 691154 - DNA, 25 bp, Rattus norvegicus
tttcgctgctgctggctagcaccta

SEQ ID NO: 691155 - DNA, 25 bp, Rattus norvegicus
tttcgcttccttatgttataatgta

SEQ ID NO: 691156 - DNA, 25 bp, Rattus norvegicus
tttcgcttccttttgttataatgta

SEQ ID NO: 691157 - DNA, 25 bp, Rattus norvegicus
tttcgctttgcaaaattggctcttt

SEQ ID NO: 691158 - DNA, 25 bp, Rattus norvegicus
tttcgctttgcataattggctcttt

SEQ ID NO: 691159 - DNA, 25 bp, Rattus norvegicus
tttcggaaatgtattgccacctgag

SEQ ID NO: 691160 - DNA, 25 bp, Rattus norvegicus
tttcggaaatgttttgccacctgag

SEQ ID NO: 691161 - DNA, 25 bp, Rattus norvegicus
tttcggacatcccaggagaggccat

SEQ ID NO: 691162 - DNA, 25 bp, Rattus norvegicus
tttcggacatccgaggagaggccat

SEQ ID NO: 691163 - DNA, 25 bp, Rattus norvegicus
tttcggaccatcacaagcacctaat

SEQ ID NO: 691164 - DNA, 25 bp, Rattus norvegicus
tttcggaccatctcaagcacctaat

SEQ ID NO: 691165 - DNA, 25 bp, Rattus norvegicus
tttcggagacacagcttcatgagta

SEQ ID NO: 691166 - DNA, 25 bp, Rattus norvegicus
tttcggagacactgcttcatgagta

SEQ ID NO: 691167 - DNA, 25 bp, Rattus norvegicus
tttcggagacagcaagcacggttgt

SEQ ID NO: 691168 - DNA, 25 bp, Rattus norvegicus
tttcggagacaggaagcacggttgt

SEQ ID NO: 691169 - DNA, 25 bp, Rattus norvegicus
tttcggagactcatgggctgctgga

SEQ ID NO: 691170 - DNA, 25 bp, Rattus norvegicus
tttcggagactcttgggctgctgga

SEQ ID NO: 691171 - DNA, 25 bp, Rattus norvegicus
tttcggagtttcacccattagctta

SEQ ID NO: 691172 - DNA, 25 bp, Rattus norvegicus
tttcggagtttctcccattagctta

SEQ ID NO: 691173 - DNA, 25 bp, Rattus norvegicus
tttcggatgactatgcagaggcctt

SEQ ID NO: 691174 - DNA, 25 bp, Rattus norvegicus
tttcggatgactttgcagaggcctt

SEQ ID NO: 691175 - DNA, 25 bp, Rattus norvegicus
tttcggcacagcaacctgcacctgg

SEQ ID NO: 691176 - DNA, 25 bp, Rattus norvegicus
tttcggcacagctacctgcacctgg

SEQ ID NO: 691177 - DNA, 25 bp, Rattus norvegicus
tttcggcatagcagtaggtcccgta

SEQ ID NO: 691178 - DNA, 25 bp, Rattus norvegicus
tttcggcatagctgtaggtcccgta

SEQ ID NO: 691179 - DNA, 25 bp, Rattus norvegicus
tttcggcccttcaagtactaagcag

SEQ ID NO: 691180 - DNA, 25 bp, Rattus norvegicus
tttcggcccttctagtactaagcag

SEQ ID NO: 691181 - DNA, 25 bp, Rattus norvegicus
tttcggcctgttctatgtgtccaga

SEQ ID NO: 691182 - DNA, 25 bp, Rattus norvegicus
tttcggcctgttgtatgtgtccaga

SEQ ID NO: 691183 - DNA, 25 bp, Rattus norvegicus
tttcggcgatcaatggttcctagct

SEQ ID NO: 691184 - DNA, 25 bp, Rattus norvegicus
tttcggcgatcattggttcctagct

SEQ ID NO: 691185 - DNA, 25 bp, Rattus norvegicus
tttcgggacatgagcattctgccta

SEQ ID NO: 691186 - DNA, 25 bp, Rattus norvegicus
tttcgggacatgtgcattctgccta

SEQ ID NO: 691187 - DNA, 25 bp, Rattus norvegicus
tttcgggagccgaacatccacgcag

SEQ ID NO: 691188 - DNA, 25 bp, Rattus norvegicus
tttcgggagccgtacatccacgcag

SEQ ID NO: 691189 - DNA, 25 bp, Rattus norvegicus
tttcgggcatcaacggaggcctgga

SEQ ID NO: 691190 - DNA, 25 bp, Rattus norvegicus
tttcgggcatcatcggaggcctgga

SEQ ID NO: 691191 - DNA, 25 bp, Rattus norvegicus
tttcgggtctgtcctaaaatgctac

SEQ ID NO: 691192 - DNA, 25 bp, Rattus norvegicus
tttcgggtctgtgctaaaatgctac

SEQ ID NO: 691193 - DNA, 25 bp, Rattus norvegicus
tttcgggttgatcaccttcgcgtgg

SEQ ID NO: 691194 - DNA, 25 bp, Rattus norvegicus
tttcgggttgatgaccttcgcgtgg

SEQ ID NO: 691195 - DNA, 25 bp, Rattus norvegicus
tttcggtaacttacttctctctggg

SEQ ID NO: 691196 - DNA, 25 bp, Rattus norvegicus
tttcggtaactttcttctctctggg

SEQ ID NO: 691197 - DNA, 25 bp, Rattus norvegicus
tttcggtcccgaaagctttcttgaa

SEQ ID NO: 691198 - DNA, 25 bp, Rattus norvegicus
tttcggtcccgatagctttcttgaa

SEQ ID NO: 691199 - DNA, 25 bp, Rattus norvegicus
tttcggtcgagccactcacagtaaa

SEQ ID NO: 691200 - DNA, 25 bp, Rattus norvegicus
tttcggtcgagcgactcacagtaaa

SEQ ID NO: 691201 - DNA, 25 bp, Rattus norvegicus
tttcggtcgtggacgtggtcagcca

SEQ ID NO: 691202 - DNA, 25 bp, Rattus norvegicus
tttcggtcgtggtcgtggtcagcca

SEQ ID NO: 691203 - DNA, 25 bp, Rattus norvegicus
tttcggtggcccatctctggcaaga

SEQ ID NO: 691204 - DNA, 25 bp, Rattus norvegicus
tttcggtggcccttctctggcaaga

SEQ ID NO: 691205 - DNA, 25 bp, Rattus norvegicus
tttcggtgtccacacctttgtagac

SEQ ID NO: 691206 - DNA, 25 bp, Rattus norvegicus
tttcggtgtccagacctttgtagac

SEQ ID NO: 691207 - DNA, 25 bp, Rattus norvegicus
tttcggttccctcaacaataactat

SEQ ID NO: 691208 - DNA, 25 bp, Rattus norvegicus
tttcggttccctgaacaataactat

SEQ ID NO: 691209 - DNA, 25 bp, Rattus norvegicus
tttcggtttcttaccagcaactagc

SEQ ID NO: 691210 - DNA, 25 bp, Rattus norvegicus
tttcggtttctttccagcaactagc

SEQ ID NO: 691211 - DNA, 25 bp, Rattus norvegicus
tttcggttttctatgacttggccat

SEQ ID NO: 691212 - DNA, 25 bp, Rattus norvegicus
tttcggttttctttgacttggccat

SEQ ID NO: 691213 - DNA, 25 bp, Rattus norvegicus
tttcgtacagcactccagcaatggg

SEQ ID NO: 691214 - DNA, 25 bp, Rattus norvegicus
tttcgtacagcagtccagcaatggg

SEQ ID NO: 691215 - DNA, 25 bp, Rattus norvegicus
tttcgtactcagcaaggccgagact

SEQ ID NO: 691216 - DNA, 25 bp, Rattus norvegicus
tttcgtactcaggaaggccgagact

SEQ ID NO: 691217 - DNA, 25 bp, Rattus norvegicus
tttcgtagctaccaacgcacctgat

SEQ ID NO: 691218 - DNA, 25 bp, Rattus norvegicus
tttcgtagctacgaacgcacctgat

SEQ ID NO: 691219 - DNA, 25 bp, Rattus norvegicus
tttcgtaggctcaatgtcctttgct

SEQ ID NO: 691220 - DNA, 25 bp, Rattus norvegicus
tttcgtaggctctatgtcctttgct

SEQ ID NO: 691221 - DNA, 25 bp, Rattus norvegicus
tttcgtcggccaatataactagcag

SEQ ID NO: 691222 - DNA, 25 bp, Rattus norvegicus
tttcgtcggccattataactagcag

SEQ ID NO: 691223 - DNA, 25 bp, Rattus norvegicus
tttcgtctgttgctttgctaatggg

SEQ ID NO: 691224 - DNA, 25 bp, Rattus norvegicus
tttcgtctgttggtttgctaatggg

SEQ ID NO: 691225 - DNA, 25 bp, Rattus norvegicus
tttcgtcttccaaaagttgttgcgg

SEQ ID NO: 691226 - DNA, 25 bp, Rattus norvegicus
tttcgtcttccataagttgttgcgg

SEQ ID NO: 691227 - DNA, 25 bp, Rattus norvegicus
tttcgtgagccgatcctgggcggca

SEQ ID NO: 691228 - DNA, 25 bp, Rattus norvegicus
tttcgtgagccgttcctgggcggca

SEQ ID NO: 691229 - DNA, 25 bp, Rattus norvegicus
tttcgtgagtatcttaccttggctt

SEQ ID NO: 691230 - DNA, 25 bp, Rattus norvegicus
tttcgtgagtatgttaccttggctt

SEQ ID NO: 691231 - DNA, 25 bp, Rattus norvegicus
tttcgtgattgccatgattcttccc

SEQ ID NO: 691232 - DNA, 25 bp, Rattus norvegicus
tttcgtgattgcgatgattcttccc

SEQ ID NO: 691233 - DNA, 25 bp, Rattus norvegicus
tttcgtggatcaagcttgtgtactt

SEQ ID NO: 691234 - DNA, 25 bp, Rattus norvegicus
tttcgtggatcatgcttgtgtactt

SEQ ID NO: 691235 - DNA, 25 bp, Rattus norvegicus
tttcgtggatgtacctcctgccaac

SEQ ID NO: 691236 - DNA, 25 bp, Rattus norvegicus
tttcgtggatgttcctcctgccaac

SEQ ID NO: 691237 - DNA, 25 bp, Rattus norvegicus
tttcgtgggtctcaactgcagcatt

SEQ ID NO: 691238 - DNA, 25 bp, Rattus norvegicus
tttcgtgggtctgaactgcagcatt

SEQ ID NO: 691239 - DNA, 25 bp, Rattus norvegicus
tttcgtggtcataatcatgtagttg

SEQ ID NO: 691240 - DNA, 25 bp, Rattus norvegicus
tttcgtggtcattatcatgtagttg

SEQ ID NO: 691241 - DNA, 25 bp, Rattus norvegicus
tttcgtgtccttacctcaggacgca

SEQ ID NO: 691242 - DNA, 25 bp, Rattus norvegicus
tttcgtgtcctttcctcaggacgca

SEQ ID NO: 691243 - DNA, 25 bp, Rattus norvegicus
tttcgtgtctgcatttgcaaccatt

SEQ ID NO: 691244 - DNA, 25 bp, Rattus norvegicus
tttcgtgtctgcttttgcaaccatt

SEQ ID NO: 691245 - DNA, 25 bp, Rattus norvegicus
tttcgtgtggtaaccccaaagagat

SEQ ID NO: 691246 - DNA, 25 bp, Rattus norvegicus
tttcgtgtggtatccccaaagagat

SEQ ID NO: 691247 - DNA, 25 bp, Rattus norvegicus
tttcgtgtgttcacctgtatttcct

SEQ ID NO: 691248 - DNA, 25 bp, Rattus norvegicus
tttcgtgtgttctcctgtatttcct

SEQ ID NO: 691249 - DNA, 25 bp, Rattus norvegicus
tttcgttcctagctgactaacagaa

SEQ ID NO: 691250 - DNA, 25 bp, Rattus norvegicus
tttcgttcctaggtgactaacagaa

SEQ ID NO: 691251 - DNA, 25 bp, Rattus norvegicus
tttcgttctcccatgcgacaggtcc

SEQ ID NO: 691252 - DNA, 25 bp, Rattus norvegicus
tttcgttctcccttgcgacaggtcc

SEQ ID NO: 691253 - DNA, 25 bp, Rattus norvegicus
tttcgttctgttcaagactggcctt

SEQ ID NO: 691254 - DNA, 25 bp, Rattus norvegicus
tttcgttctgttgaagactggcctt

SEQ ID NO: 691255 - DNA, 25 bp, Rattus norvegicus
tttcgttcttgacgtgcacggcgga

SEQ ID NO: 691256 - DNA, 25 bp, Rattus norvegicus
tttcgttcttgaggtgcacggcgga

SEQ ID NO: 691257 - DNA, 25 bp, Rattus norvegicus
tttcgtttgttgctagccagagcct

SEQ ID NO: 691258 - DNA, 25 bp, Rattus norvegicus
tttcgtttgttggtagccagagcct

SEQ ID NO: 691259 - DNA, 25 bp, Rattus norvegicus
tttcgttttgaaacctgttccagaa

SEQ ID NO: 691260 - DNA, 25 bp, Rattus norvegicus
tttcgttttgaatcctgttccagaa

SEQ ID NO: 691261 - DNA, 25 bp, Rattus norvegicus
tttctaaaacacactccaaggcatt

SEQ ID NO: 691262 - DNA, 25 bp, Rattus norvegicus
tttctaaaacactctccaaggcatt

SEQ ID NO: 691263 - DNA, 25 bp, Rattus norvegicus
tttctaaacctgagctgtggactcc

SEQ ID NO: 691264 - DNA, 25 bp, Rattus norvegicus
tttctaaacctgtgctgtggactcc

SEQ ID NO: 691265 - DNA, 25 bp, Rattus norvegicus
tttctaaagcaaaccaagagggtga

SEQ ID NO: 691266 - DNA, 25 bp, Rattus norvegicus
tttctaaagcaatccaagagggtga

SEQ ID NO: 691267 - DNA, 25 bp, Rattus norvegicus
tttctaaagcctagtccccaggcat

SEQ ID NO: 691268 - DNA, 25 bp, Rattus norvegicus
tttctaaagccttgtccccaggcat

SEQ ID NO: 691269 - DNA, 25 bp, Rattus norvegicus
tttctaaagcgcagtgggaagcagg

SEQ ID NO: 691270 - DNA, 25 bp, Rattus norvegicus
tttctaaagcgctgtgggaagcagg

SEQ ID NO: 691271 - DNA, 25 bp, Rattus norvegicus
tttctaacactgagccctggtggag

SEQ ID NO: 691272 - DNA, 25 bp, Rattus norvegicus
tttctaacactgtgccctggtggag

SEQ ID NO: 691273 - DNA, 25 bp, Rattus norvegicus
tttctaacatgtacatctctcgatg

SEQ ID NO: 691274 - DNA, 25 bp, Rattus norvegicus
tttctaacatgttcatctctcgatg

SEQ ID NO: 691275 - DNA, 25 bp, Rattus norvegicus
tttctaacccgcacaaatgcttttc

SEQ ID NO: 691276 - DNA, 25 bp, Rattus norvegicus
tttctaacccgctcaaatgcttttc

SEQ ID NO: 691277 - DNA, 25 bp, Rattus norvegicus
tttctaaccgcactcactctaggat

SEQ ID NO: 691278 - DNA, 25 bp, Rattus norvegicus
tttctaaccgcagtcactctaggat

SEQ ID NO: 691279 - DNA, 25 bp, Rattus norvegicus
tttctaagcagaatgtcaccagtgt

SEQ ID NO: 691280 - DNA, 25 bp, Rattus norvegicus
tttctaagcagattgtcaccagtgt

SEQ ID NO: 691281 - DNA, 25 bp, Rattus norvegicus
tttctaagccccaaacagtagctgg

SEQ ID NO: 691282 - DNA, 25 bp, Rattus norvegicus
tttctaagcccctaacagtagctgg

SEQ ID NO: 691283 - DNA, 25 bp, Rattus norvegicus
tttctaagcgccaaagggtcaggtg

SEQ ID NO: 691284 - DNA, 25 bp, Rattus norvegicus
tttctaagcgcctaagggtcaggtg

SEQ ID NO: 691285 - DNA, 25 bp, Rattus norvegicus
tttctaaggccacccagcccacaaa

SEQ ID NO: 691286 - DNA, 25 bp, Rattus norvegicus
tttctaaggccagccagcccacaaa

SEQ ID NO: 691287 - DNA, 25 bp, Rattus norvegicus
tttctaagggtgacagcctccacag

SEQ ID NO: 691288 - DNA, 25 bp, Rattus norvegicus
tttctaagggtgtcagcctccacag

SEQ ID NO: 691289 - DNA, 25 bp, Rattus norvegicus
tttctaatagtaaccggtcggtcca

SEQ ID NO: 691290 - DNA, 25 bp, Rattus norvegicus
tttctaatagtatccggtcggtcca

SEQ ID NO: 691291 - DNA, 25 bp, Rattus norvegicus
tttctaatcacccagccttgtagtg

SEQ ID NO: 691292 - DNA, 25 bp, Rattus norvegicus
tttctaatcaccgagccttgtagtg

SEQ ID NO: 691293 - DNA, 25 bp, Rattus norvegicus
tttctaatgtctcatgtgtccccaa

SEQ ID NO: 691294 - DNA, 25 bp, Rattus norvegicus
tttctaatgtctcttgtacttgtac

SEQ ID NO: 691295 - DNA, 25 bp, Rattus norvegicus
tttctaatgtctgatgtgtccccaa

SEQ ID NO: 691296 - DNA, 25 bp, Rattus norvegicus
tttctaatgtctgttgtacttgtac

SEQ ID NO: 691297 - DNA, 25 bp, Rattus norvegicus
tttctaatttgtctccccttcattt

SEQ ID NO: 691298 - DNA, 25 bp, Rattus norvegicus
tttctaatttgtgtccccttcattt

SEQ ID NO: 691299 - DNA, 25 bp, Rattus norvegicus
tttctacaatgacctgcgtgtggcc

SEQ ID NO: 691300 - DNA, 25 bp, Rattus norvegicus
tttctacaatgagctgcgtgtggcc

SEQ ID NO: 691301 - DNA, 25 bp, Rattus norvegicus
tttctacacactatatcatccactc

SEQ ID NO: 691302 - DNA, 25 bp, Rattus norvegicus
tttctacacactttatcatccactc

SEQ ID NO: 691303 - DNA, 25 bp, Rattus norvegicus
tttctacacagacaggattcactat

SEQ ID NO: 691304 - DNA, 25 bp, Rattus norvegicus
tttctacacagagaggattcactat

SEQ ID NO: 691305 - DNA, 25 bp, Rattus norvegicus
tttctacactttatcatccgctaag

SEQ ID NO: 691306 - DNA, 25 bp, Rattus norvegicus
tttctacactttttcatccgctaag

SEQ ID NO: 691307 - DNA, 25 bp, Rattus norvegicus
tttctacagaagacggagcccggag

SEQ ID NO: 691308 - DNA, 25 bp, Rattus norvegicus
tttctacagaagtcggagcccggag

SEQ ID NO: 691309 - DNA, 25 bp, Rattus norvegicus
tttctacagaccaggccgcccttga

SEQ ID NO: 691310 - DNA, 25 bp, Rattus norvegicus
tttctacagacctggccgcccttga

SEQ ID NO: 691311 - DNA, 25 bp, Rattus norvegicus
tttctacagattcctttgccacact

SEQ ID NO: 691312 - DNA, 25 bp, Rattus norvegicus
tttctacagattgctttgccacact

SEQ ID NO: 691313 - DNA, 25 bp, Rattus norvegicus
tttctacagccactgcttgggaaca

SEQ ID NO: 691314 - DNA, 25 bp, Rattus norvegicus
tttctacagccagtgcttgggaaca

SEQ ID NO: 691315 - DNA, 25 bp, Rattus norvegicus
tttctacagcttactttttccttct

SEQ ID NO: 691316 - DNA, 25 bp, Rattus norvegicus
tttctacagctttctttttccttct

SEQ ID NO: 691317 - DNA, 25 bp, Rattus norvegicus
tttctacataagctctcctggtcca

SEQ ID NO: 691318 - DNA, 25 bp, Rattus norvegicus
tttctacataaggtctcctggtcca

SEQ ID NO: 691319 - DNA, 25 bp, Rattus norvegicus
tttctacatatgaactgctgctgag

SEQ ID NO: 691320 - DNA, 25 bp, Rattus norvegicus
tttctacatatgtactgctgctgag

SEQ ID NO: 691321 - DNA, 25 bp, Rattus norvegicus
tttctacattaaccaccttacacct

SEQ ID NO: 691322 - DNA, 25 bp, Rattus norvegicus
tttctacattaagcaccttacacct

SEQ ID NO: 691323 - DNA, 25 bp, Rattus norvegicus
tttctacattttaaagagcccttag

SEQ ID NO: 691324 - DNA, 25 bp, Rattus norvegicus
tttctacatttttaagagcccttag

SEQ ID NO: 691325 - DNA, 25 bp, Rattus norvegicus
tttctaccaaatacatcacgctcat

SEQ ID NO: 691326 - DNA, 25 bp, Rattus norvegicus
tttctaccaaattcatcacgctcat

SEQ ID NO: 691327 - DNA, 25 bp, Rattus norvegicus
tttctacccacaccatttgagtgtc

SEQ ID NO: 691328 - DNA, 25 bp, Rattus norvegicus
tttctacccacagcatttgagtgtc

SEQ ID NO: 691329 - DNA, 25 bp, Rattus norvegicus
tttctacccattcagtcaggttctg

SEQ ID NO: 691330 - DNA, 25 bp, Rattus norvegicus
tttctacccattgagtcaggttctg

SEQ ID NO: 691331 - DNA, 25 bp, Rattus norvegicus
tttctaccccacatagagcacatat

SEQ ID NO: 691332 - DNA, 25 bp, Rattus norvegicus
tttctaccccacttagagcacatat

SEQ ID NO: 691333 - DNA, 25 bp, Rattus norvegicus
tttctaccccggagacaacttggag

SEQ ID NO: 691334 - DNA, 25 bp, Rattus norvegicus
tttctaccccggtgacaacttggag

SEQ ID NO: 691335 - DNA, 25 bp, Rattus norvegicus
tttctaccgggacgttggaactgct

SEQ ID NO: 691336 - DNA, 25 bp, Rattus norvegicus
tttctaccgggaggttggaactgct

SEQ ID NO: 691337 - DNA, 25 bp, Rattus norvegicus
tttctacctagaatgctcagctggg

SEQ ID NO: 691338 - DNA, 25 bp, Rattus norvegicus
tttctacctagattgctcagctggg

SEQ ID NO: 691339 - DNA, 25 bp, Rattus norvegicus
tttctacctcttcactggagcgtga

SEQ ID NO: 691340 - DNA, 25 bp, Rattus norvegicus
tttctacctcttgactggagcgtga

SEQ ID NO: 691341 - DNA, 25 bp, Rattus norvegicus
tttctacggttgcaaactgctgacc

SEQ ID NO: 691342 - DNA, 25 bp, Rattus norvegicus
tttctacggttggaaactgctgacc

SEQ ID NO: 691343 - DNA, 25 bp, Rattus norvegicus
tttctacgttgcctgtctatgacat

SEQ ID NO: 691344 - DNA, 25 bp, Rattus norvegicus
tttctacgttgcgtgtctatgacat

SEQ ID NO: 691345 - DNA, 25 bp, Rattus norvegicus
tttctactatccatgacacacacac

SEQ ID NO: 691346 - DNA, 25 bp, Rattus norvegicus
tttctactatccttgacacacacac

SEQ ID NO: 691347 - DNA, 25 bp, Rattus norvegicus
tttctactcttcaacaaaccagttt

SEQ ID NO: 691348 - DNA, 25 bp, Rattus norvegicus
tttctactcttcaacggccagatca

SEQ ID NO: 691349 - DNA, 25 bp, Rattus norvegicus
tttctactcttctacaaaccagttt

SEQ ID NO: 691350 - DNA, 25 bp, Rattus norvegicus
tttctactcttctacggccagatca

SEQ ID NO: 691351 - DNA, 25 bp, Rattus norvegicus
tttctactgcccagtgcaagatcat

SEQ ID NO: 691352 - DNA, 25 bp, Rattus norvegicus
tttctactgccctgtgcaagatcat

SEQ ID NO: 691353 - DNA, 25 bp, Rattus norvegicus
tttctacttatgacatcgggctctg

SEQ ID NO: 691354 - DNA, 25 bp, Rattus norvegicus
tttctacttatgtcatcgggctctg

SEQ ID NO: 691355 - DNA, 25 bp, Rattus norvegicus
tttctacttgtgcagttgtcagccc

SEQ ID NO: 691356 - DNA, 25 bp, Rattus norvegicus
tttctacttgtggagttgtcagccc

SEQ ID NO: 691357 - DNA, 25 bp, Rattus norvegicus
tttctagaactgagaccaacccatc

SEQ ID NO: 691358 - DNA, 25 bp, Rattus norvegicus
tttctagaactgtgaccaacccatc

SEQ ID NO: 691359 - DNA, 25 bp, Rattus norvegicus
tttctagacagaaaccaggacccaa

SEQ ID NO: 691360 - DNA, 25 bp, Rattus norvegicus
tttctagacagataccaggacccaa

SEQ ID NO: 691361 - DNA, 25 bp, Rattus norvegicus
tttctagcagtcattgcccacctaa

SEQ ID NO: 691362 - DNA, 25 bp, Rattus norvegicus
tttctagcagtctttgcccacctaa

SEQ ID NO: 691363 - DNA, 25 bp, Rattus norvegicus
tttctagccaatatcccatttccta

SEQ ID NO: 691364 - DNA, 25 bp, Rattus norvegicus
tttctagccaatttcccatttccta

SEQ ID NO: 691365 - DNA, 25 bp, Rattus norvegicus
tttctagccggtcttgctctatctc

SEQ ID NO: 691366 - DNA, 25 bp, Rattus norvegicus
tttctagccggtgttgctctatctc

SEQ ID NO: 691367 - DNA, 25 bp, Rattus norvegicus
tttctagctaaaacttgcctcttaa

SEQ ID NO: 691368 - DNA, 25 bp, Rattus norvegicus
tttctagctaaatcttgcctcttaa

SEQ ID NO: 691369 - DNA, 25 bp, Rattus norvegicus
tttctagctgggacatttcctggag

SEQ ID NO: 691370 - DNA, 25 bp, Rattus norvegicus
tttctagctgggtcatttcctggag

SEQ ID NO: 691371 - DNA, 25 bp, Rattus norvegicus
tttctagctttcacacatggcggaa

SEQ ID NO: 691372 - DNA, 25 bp, Rattus norvegicus
tttctagctttctcacatggcggaa

SEQ ID NO: 691373 - DNA, 25 bp, Rattus norvegicus
tttctaggaaacatagtggaggcta

SEQ ID NO: 691374 - DNA, 25 bp, Rattus norvegicus
tttctaggaaacttagtggaggcta

SEQ ID NO: 691375 - DNA, 25 bp, Rattus norvegicus
tttctagggcacagaactaatttca

SEQ ID NO: 691376 - DNA, 25 bp, Rattus norvegicus
tttctagggcactgaactaatttca

SEQ ID NO: 691377 - DNA, 25 bp, Rattus norvegicus
tttctaggtgacatcgctgggcgca

SEQ ID NO: 691378 - DNA, 25 bp, Rattus norvegicus
tttctaggtgacttcgctgggcgca

SEQ ID NO: 691379 - DNA, 25 bp, Rattus norvegicus
tttctaggtttgagtggcgttgata

SEQ ID NO: 691380 - DNA, 25 bp, Rattus norvegicus
tttctaggtttgtgtggcgttgata

SEQ ID NO: 691381 - DNA, 25 bp, Rattus norvegicus
tttctagtcatcaacacagctgtcc

SEQ ID NO: 691382 - DNA, 25 bp, Rattus norvegicus
tttctagtcatctacacagctgtcc

SEQ ID NO: 691383 - DNA, 25 bp, Rattus norvegicus
tttctagtctagcttctgaacgcat

SEQ ID NO: 691384 - DNA, 25 bp, Rattus norvegicus
tttctagtctaggttctgaacgcat

SEQ ID NO: 691385 - DNA, 25 bp, Rattus norvegicus
tttctagttccaccattgtccaagt

SEQ ID NO: 691386 - DNA, 25 bp, Rattus norvegicus
tttctagttccagcattgtccaagt

SEQ ID NO: 691387 - DNA, 25 bp, Rattus norvegicus
tttctatagaccagactttttgttt

SEQ ID NO: 691388 - DNA, 25 bp, Rattus norvegicus
tttctatagacctgactttttgttt

SEQ ID NO: 691389 - DNA, 25 bp, Rattus norvegicus
tttctataggcgctctcacccaaac

SEQ ID NO: 691390 - DNA, 25 bp, Rattus norvegicus
tttctataggcggtctcacccaaac

SEQ ID NO: 691391 - DNA, 25 bp, Rattus norvegicus
tttctatatactcagccacaaggct

SEQ ID NO: 691392 - DNA, 25 bp, Rattus norvegicus
tttctatatactgagccacaaggct

SEQ ID NO: 691393 - DNA, 25 bp, Rattus norvegicus
tttctatcatctaactcacagtctc

SEQ ID NO: 691394 - DNA, 25 bp, Rattus norvegicus
tttctatcatcttactcacagtctc

SEQ ID NO: 691395 - DNA, 25 bp, Rattus norvegicus
tttctatccagcatcagccacagaa

SEQ ID NO: 691396 - DNA, 25 bp, Rattus norvegicus
tttctatccagcttcagccacagaa

SEQ ID NO: 691397 - DNA, 25 bp, Rattus norvegicus
tttctatccagtctgtggcacacag

SEQ ID NO: 691398 - DNA, 25 bp, Rattus norvegicus
tttctatccagtgtgtggcacacag

SEQ ID NO: 691399 - DNA, 25 bp, Rattus norvegicus
tttctatgagtgctttctctttttt

SEQ ID NO: 691400 - DNA, 25 bp, Rattus norvegicus
tttctatgagtggtttctctttttt

SEQ ID NO: 691401 - DNA, 25 bp, Rattus norvegicus
tttctatgtgacctcagcattgcgg

SEQ ID NO: 691402 - DNA, 25 bp, Rattus norvegicus
tttctatgtgacgtcagcattgcgg

SEQ ID NO: 691403 - DNA, 25 bp, Rattus norvegicus
tttctatgtgtcaaactgggcccag

SEQ ID NO: 691404 - DNA, 25 bp, Rattus norvegicus
tttctatgtgtctaactgggcccag

SEQ ID NO: 691405 - DNA, 25 bp, Rattus norvegicus
tttctatgttgcctggaggagtcca

SEQ ID NO: 691406 - DNA, 25 bp, Rattus norvegicus
tttctatgttgcgtggaggagtcca

SEQ ID NO: 691407 - DNA, 25 bp, Rattus norvegicus
tttctattcactattcctgctggag

SEQ ID NO: 691408 - DNA, 25 bp, Rattus norvegicus
tttctattcacttttcctgctggag

SEQ ID NO: 691409 - DNA, 25 bp, Rattus norvegicus
tttctattccgactcatccatcaag

SEQ ID NO: 691410 - DNA, 25 bp, Rattus norvegicus
tttctattccgagtcatccatcaag

SEQ ID NO: 691411 - DNA, 25 bp, Rattus norvegicus
tttctattgaatatgggactgccct

SEQ ID NO: 691412 - DNA, 25 bp, Rattus norvegicus
tttctattgaatttgggactgccct

SEQ ID NO: 691413 - DNA, 25 bp, Rattus norvegicus
tttctattgggaaatctgcagcacc

SEQ ID NO: 691414 - DNA, 25 bp, Rattus norvegicus
tttctattgggatatctgcagcacc

SEQ ID NO: 691415 - DNA, 25 bp, Rattus norvegicus
tttctatttttactgtctctagaca

SEQ ID NO: 691416 - DNA, 25 bp, Rattus norvegicus
tttctatttttagtgtctctagaca

SEQ ID NO: 691417 - DNA, 25 bp, Rattus norvegicus
tttctcaaaacgattcaccgagcgt

SEQ ID NO: 691418 - DNA, 25 bp, Rattus norvegicus
tttctcaaaacgtttcaccgagcgt

SEQ ID NO: 691419 - DNA, 25 bp, Rattus norvegicus
tttctcaaaccaatgcctggagtgt

SEQ ID NO: 691420 - DNA, 25 bp, Rattus norvegicus
tttctcaaaccattgcctggagtgt

SEQ ID NO: 691421 - DNA, 25 bp, Rattus norvegicus
tttctcaaccagacctagcggaagg

SEQ ID NO: 691422 - DNA, 25 bp, Rattus norvegicus
tttctcaaccagtcctagcggaagg

SEQ ID NO: 691423 - DNA, 25 bp, Rattus norvegicus
tttctcaactctatgaatcccctat

SEQ ID NO: 691424 - DNA, 25 bp, Rattus norvegicus
tttctcaactctttgaatcccctat

SEQ ID NO: 691425 - DNA, 25 bp, Rattus norvegicus
tttctcaagaacaccacagcacggg

SEQ ID NO: 691426 - DNA, 25 bp, Rattus norvegicus
tttctcaagaactccacagcacggg

SEQ ID NO: 691427 - DNA, 25 bp, Rattus norvegicus
tttctcaaggaacctggctagcctg

SEQ ID NO: 691428 - DNA, 25 bp, Rattus norvegicus
tttctcaaggaagctggctagcctg

SEQ ID NO: 691429 - DNA, 25 bp, Rattus norvegicus
tttctcaaggccagttccaaacatc

SEQ ID NO: 691430 - DNA, 25 bp, Rattus norvegicus
tttctcaaggcctgttccaaacatc

SEQ ID NO: 691431 - DNA, 25 bp, Rattus norvegicus
tttctcacactccaaggtccagata

SEQ ID NO: 691432 - DNA, 25 bp, Rattus norvegicus
tttctcacactcgaaggtccagata

SEQ ID NO: 691433 - DNA, 25 bp, Rattus norvegicus
tttctcacagccatggattctctga

SEQ ID NO: 691434 - DNA, 25 bp, Rattus norvegicus
tttctcacagccttggattctctga

SEQ ID NO: 691435 - DNA, 25 bp, Rattus norvegicus
tttctcacaggaattccccagacta

SEQ ID NO: 691436 - DNA, 25 bp, Rattus norvegicus
tttctcacaggatttccccagacta

SEQ ID NO: 691437 - DNA, 25 bp, Rattus norvegicus
tttctcacaggtacactgcttaaag

SEQ ID NO: 691438 - DNA, 25 bp, Rattus norvegicus
tttctcacaggttcactgcttaaag

SEQ ID NO: 691439 - DNA, 25 bp, Rattus norvegicus
tttctcaccactctaccctaaagga

SEQ ID NO: 691440 - DNA, 25 bp, Rattus norvegicus
tttctcaccactgtaccctaaagga

SEQ ID NO: 691441 - DNA, 25 bp, Rattus norvegicus
tttctcaccgtacccagtaaataag

SEQ ID NO: 691442 - DNA, 25 bp, Rattus norvegicus
tttctcaccgtagccagtaaataag

SEQ ID NO: 691443 - DNA, 25 bp, Rattus norvegicus
tttctcacgtcacgcacatcagtaa

SEQ ID NO: 691444 - DNA, 25 bp, Rattus norvegicus
tttctcacgtcaggcacatcagtaa

SEQ ID NO: 691445 - DNA, 25 bp, Rattus norvegicus
tttctcactcagaggccctgttaaa

SEQ ID NO: 691446 - DNA, 25 bp, Rattus norvegicus
tttctcactcagtggccctgttaaa

SEQ ID NO: 691447 - DNA, 25 bp, Rattus norvegicus
tttctcactgggagccttccaagtt

SEQ ID NO: 691448 - DNA, 25 bp, Rattus norvegicus
tttctcactgggtgccttccaagtt

SEQ ID NO: 691449 - DNA, 25 bp, Rattus norvegicus
tttctcacttggactttacatggaa

SEQ ID NO: 691450 - DNA, 25 bp, Rattus norvegicus
tttctcacttggtctttacatggaa

SEQ ID NO: 691451 - DNA, 25 bp, Rattus norvegicus
tttctcactttccataaccagtctt

SEQ ID NO: 691452 - DNA, 25 bp, Rattus norvegicus
tttctcactttcgataaccagtctt

SEQ ID NO: 691453 - DNA, 25 bp, Rattus norvegicus
tttctcacttttccttcccattctt

SEQ ID NO: 691454 - DNA, 25 bp, Rattus norvegicus
tttctcacttttgcttcccattctt

SEQ ID NO: 691455 - DNA, 25 bp, Rattus norvegicus
tttctcagactaagctccagcagca

SEQ ID NO: 691456 - DNA, 25 bp, Rattus norvegicus
tttctcagactatgctccagcagca

SEQ ID NO: 691457 - DNA, 25 bp, Rattus norvegicus
tttctcagactcatcaggtgcagtt

SEQ ID NO: 691458 - DNA, 25 bp, Rattus norvegicus
tttctcagactcttcaggtgcagtt

SEQ ID NO: 691459 - DNA, 25 bp, Rattus norvegicus
tttctcagagtcaccctccaggttt

SEQ ID NO: 691460 - DNA, 25 bp, Rattus norvegicus
tttctcagagtctccctccaggttt

SEQ ID NO: 691461 - DNA, 25 bp, Rattus norvegicus
tttctcagcagtataaagccttaag

SEQ ID NO: 691462 - DNA, 25 bp, Rattus norvegicus
tttctcagcagtttaaagccttaag

SEQ ID NO: 691463 - DNA, 25 bp, Rattus norvegicus
tttctcagcctgactagatgtcagt

SEQ ID NO: 691464 - DNA, 25 bp, Rattus norvegicus
tttctcagcctgtctagatgtcagt

SEQ ID NO: 691465 - DNA, 25 bp, Rattus norvegicus
tttctcagctcaacaacatgctctg

SEQ ID NO: 691466 - DNA, 25 bp, Rattus norvegicus
tttctcagctcatcaacatgctctg

SEQ ID NO: 691467 - DNA, 25 bp, Rattus norvegicus
tttctcagctctcatcaacattcat

SEQ ID NO: 691468 - DNA, 25 bp, Rattus norvegicus
tttctcagctctgatcaacattcat

SEQ ID NO: 691469 - DNA, 25 bp, Rattus norvegicus
tttctcaggagtcacatatcagata

SEQ ID NO: 691470 - DNA, 25 bp, Rattus norvegicus
tttctcaggagtgacatatcagata

SEQ ID NO: 691471 - DNA, 25 bp, Rattus norvegicus
tttctcagggagatttcttcgaata

SEQ ID NO: 691472 - DNA, 25 bp, Rattus norvegicus
tttctcagggagttttcttcgaata

SEQ ID NO: 691473 - DNA, 25 bp, Rattus norvegicus
tttctcaggtttcccagttcgtggc

SEQ ID NO: 691474 - DNA, 25 bp, Rattus norvegicus
tttctcaggtttgccagttcgtggc

SEQ ID NO: 691475 - DNA, 25 bp, Rattus norvegicus
tttctcagtgtcaacaatgtaccca

SEQ ID NO: 691476 - DNA, 25 bp, Rattus norvegicus
tttctcagtgtctacaatgtaccca

SEQ ID NO: 691477 - DNA, 25 bp, Rattus norvegicus
tttctcatacccaggcttgacagga

SEQ ID NO: 691478 - DNA, 25 bp, Rattus norvegicus
tttctcataccctggcttgacagga

SEQ ID NO: 691479 - DNA, 25 bp, Rattus norvegicus
tttctcatatcaatcgctctctaga

SEQ ID NO: 691480 - DNA, 25 bp, Rattus norvegicus
tttctcatatcattcgctctctaga

SEQ ID NO: 691481 - DNA, 25 bp, Rattus norvegicus
tttctcatccgcaggctgctttttt

SEQ ID NO: 691482 - DNA, 25 bp, Rattus norvegicus
tttctcatccgctggctgctttttt

SEQ ID NO: 691483 - DNA, 25 bp, Rattus norvegicus
tttctcatcgtcatttcagtcacag

SEQ ID NO: 691484 - DNA, 25 bp, Rattus norvegicus
tttctcatcgtcttttcagtcacag

SEQ ID NO: 691485 - DNA, 25 bp, Rattus norvegicus
tttctcatctctaagcagcttgact

SEQ ID NO: 691486 - DNA, 25 bp, Rattus norvegicus
tttctcatctctctcggtcaatggt

SEQ ID NO: 691487 - DNA, 25 bp, Rattus norvegicus
tttctcatctctgtcggtcaatggt

SEQ ID NO: 691488 - DNA, 25 bp, Rattus norvegicus
tttctcatctcttagcagcttgact

SEQ ID NO: 691489 - DNA, 25 bp, Rattus norvegicus
tttctcatctgcaatagctgctggg

SEQ ID NO: 691490 - DNA, 25 bp, Rattus norvegicus
tttctcatctgctatagctgctggg

SEQ ID NO: 691491 - DNA, 25 bp, Rattus norvegicus
tttctcatgactactttcttccaca

SEQ ID NO: 691492 - DNA, 25 bp, Rattus norvegicus
tttctcatgacttctttcttccaca

SEQ ID NO: 691493 - DNA, 25 bp, Rattus norvegicus
tttctcatggtaaccttacgcctca

SEQ ID NO: 691494 - DNA, 25 bp, Rattus norvegicus
tttctcatggtatccttacgcctca

SEQ ID NO: 691495 - DNA, 25 bp, Rattus norvegicus
tttctcatggtcacagttcctaagt

SEQ ID NO: 691496 - DNA, 25 bp, Rattus norvegicus
tttctcatggtctcagttcctaagt

SEQ ID NO: 691497 - DNA, 25 bp, Rattus norvegicus
tttctcattagaaaccaaatggtgt

SEQ ID NO: 691498 - DNA, 25 bp, Rattus norvegicus
tttctcattagataccaaatggtgt

SEQ ID NO: 691499 - DNA, 25 bp, Rattus norvegicus
tttctcatttgccttgggcactgga

SEQ ID NO: 691500 - DNA, 25 bp, Rattus norvegicus
tttctcatttgcgttgggcactgga

SEQ ID NO: 691501 - DNA, 25 bp, Rattus norvegicus
tttctccaaagcatactgagcccgg

SEQ ID NO: 691502 - DNA, 25 bp, Rattus norvegicus
tttctccaaagcttactgagcccgg

SEQ ID NO: 691503 - DNA, 25 bp, Rattus norvegicus
tttctccaacgccatgtaacatttc

SEQ ID NO: 691504 - DNA, 25 bp, Rattus norvegicus
tttctccaacgcgatgtaacatttc

SEQ ID NO: 691505 - DNA, 25 bp, Rattus norvegicus
tttctccacgtgagggtcgaaggct

SEQ ID NO: 691506 - DNA, 25 bp, Rattus norvegicus
tttctccacgtgtgggtcgaaggct

SEQ ID NO: 691507 - DNA, 25 bp, Rattus norvegicus
tttctccactgaatgcagtctgcac

SEQ ID NO: 691508 - DNA, 25 bp, Rattus norvegicus
tttctccactgattgcagtctgcac

SEQ ID NO: 691509 - DNA, 25 bp, Rattus norvegicus
tttctccactggcaagcgattctgc

SEQ ID NO: 691510 - DNA, 25 bp, Rattus norvegicus
tttctccactgggaagcgattctgc

SEQ ID NO: 691511 - DNA, 25 bp, Rattus norvegicus
tttctccacttaacatcatgatccc

SEQ ID NO: 691512 - DNA, 25 bp, Rattus norvegicus
tttctccacttatcatcatgatccc

SEQ ID NO: 691513 - DNA, 25 bp, Rattus norvegicus
tttctccagagtcacctaatccagt

SEQ ID NO: 691514 - DNA, 25 bp, Rattus norvegicus
tttctccagagtgacctaatccagt

SEQ ID NO: 691515 - DNA, 25 bp, Rattus norvegicus
tttctccaggacatcttggcaggtg

SEQ ID NO: 691516 - DNA, 25 bp, Rattus norvegicus
tttctccaggacttcttggcaggtg

SEQ ID NO: 691517 - DNA, 25 bp, Rattus norvegicus
tttctccagggcagcaggtacaggt

SEQ ID NO: 691518 - DNA, 25 bp, Rattus norvegicus
tttctccagggctgcaggtacaggt

SEQ ID NO: 691519 - DNA, 25 bp, Rattus norvegicus
tttctccaggtcagatcatcttgct

SEQ ID NO: 691520 - DNA, 25 bp, Rattus norvegicus
tttctccaggtctgatcatcttgct

SEQ ID NO: 691521 - DNA, 25 bp, Rattus norvegicus
tttctccatatacacacattgcacc

SEQ ID NO: 691522 - DNA, 25 bp, Rattus norvegicus
tttctccatatagacacattgcacc

SEQ ID NO: 691523 - DNA, 25 bp, Rattus norvegicus
tttctccatcataggccatccagag

SEQ ID NO: 691524 - DNA, 25 bp, Rattus norvegicus
tttctccatcattggccatccagag

SEQ ID NO: 691525 - DNA, 25 bp, Rattus norvegicus
tttctccatcttctctcaggtatag

SEQ ID NO: 691526 - DNA, 25 bp, Rattus norvegicus
tttctccatcttgtctcaggtatag

SEQ ID NO: 691527 - DNA, 25 bp, Rattus norvegicus
tttctccattatactactgtgctat

SEQ ID NO: 691528 - DNA, 25 bp, Rattus norvegicus
tttctccattattctactgtgctat

SEQ ID NO: 691529 - DNA, 25 bp, Rattus norvegicus
tttctccatttgagctgtttcttat

SEQ ID NO: 691530 - DNA, 25 bp, Rattus norvegicus
tttctccatttgtgctgtttcttat

SEQ ID NO: 691531 - DNA, 25 bp, Rattus norvegicus
tttctcccaagacctgtgtttacta

SEQ ID NO: 691532 - DNA, 25 bp, Rattus norvegicus
tttctcccaagagctgtgtttacta

SEQ ID NO: 691533 - DNA, 25 bp, Rattus norvegicus
tttctcccacgccatgccagtgtgg

SEQ ID NO: 691534 - DNA, 25 bp, Rattus norvegicus
tttctcccacgcgatgccagtgtgg

SEQ ID NO: 691535 - DNA, 25 bp, Rattus norvegicus
tttctcccagtcagtttccaaaagt

SEQ ID NO: 691536 - DNA, 25 bp, Rattus norvegicus
tttctcccagtctgtttccaaaagt

SEQ ID NO: 691537 - DNA, 25 bp, Rattus norvegicus
tttctcccatcacttgtgttcctca

SEQ ID NO: 691538 - DNA, 25 bp, Rattus norvegicus
tttctcccatcagttgtgttcctca

SEQ ID NO: 691539 - DNA, 25 bp, Rattus norvegicus
tttctcccatctatcaactgttgag

SEQ ID NO: 691540 - DNA, 25 bp, Rattus norvegicus
tttctcccatctttcaactgttgag

SEQ ID NO: 691541 - DNA, 25 bp, Rattus norvegicus
tttctcccatgtaactcaagatgct

SEQ ID NO: 691542 - DNA, 25 bp, Rattus norvegicus
tttctcccatgttactcaagatgct

SEQ ID NO: 691543 - DNA, 25 bp, Rattus norvegicus
tttctccctctgaaacttgagttga

SEQ ID NO: 691544 - DNA, 25 bp, Rattus norvegicus
tttctccctctgtaacttgagttga

SEQ ID NO: 691545 - DNA, 25 bp, Rattus norvegicus
tttctccctgccattaggcacaaac

SEQ ID NO: 691546 - DNA, 25 bp, Rattus norvegicus
tttctccctgcctttaggcacaaac

SEQ ID NO: 691547 - DNA, 25 bp, Rattus norvegicus
tttctcccttcacttaacagttttg

SEQ ID NO: 691548 - DNA, 25 bp, Rattus norvegicus
tttctcccttcagttaacagttttg

SEQ ID NO: 691549 - DNA, 25 bp, Rattus norvegicus
tttctcccttgcaattggtccctat

SEQ ID NO: 691550 - DNA, 25 bp, Rattus norvegicus
tttctcccttgctattggtccctat

SEQ ID NO: 691551 - DNA, 25 bp, Rattus norvegicus
tttctccgagataaaccaaatttat

SEQ ID NO: 691552 - DNA, 25 bp, Rattus norvegicus
tttctccgagattaaccaaatttat

SEQ ID NO: 691553 - DNA, 25 bp, Rattus norvegicus
tttctccgcccacgtttttttgctg

SEQ ID NO: 691554 - DNA, 25 bp, Rattus norvegicus
tttctccgcccaggtttttttgctg

SEQ ID NO: 691555 - DNA, 25 bp, Rattus norvegicus
tttctccgcgctcactaatttattt

SEQ ID NO: 691556 - DNA, 25 bp, Rattus norvegicus
tttctccgcgctgactaatttattt

SEQ ID NO: 691557 - DNA, 25 bp, Rattus norvegicus
tttctccgtgcaccctgtaggagac

SEQ ID NO: 691558 - DNA, 25 bp, Rattus norvegicus
tttctccgtgcagcctgtaggagac

SEQ ID NO: 691559 - DNA, 25 bp, Rattus norvegicus
tttctcctacagagtgtgaatactt

SEQ ID NO: 691560 - DNA, 25 bp, Rattus norvegicus
tttctcctacagtgtgtgaatactt

SEQ ID NO: 691561 - DNA, 25 bp, Rattus norvegicus
tttctcctagagagtgcgtgtgcct

SEQ ID NO: 691562 - DNA, 25 bp, Rattus norvegicus
tttctcctagagtgtgcgtgtgcct

SEQ ID NO: 691563 - DNA, 25 bp, Rattus norvegicus
tttctcctaggactcttagcgattc

SEQ ID NO: 691564 - DNA, 25 bp, Rattus norvegicus
tttctcctaggagtcttagcgattc

SEQ ID NO: 691565 - DNA, 25 bp, Rattus norvegicus
tttctcctcaagagcactgagtgtc

SEQ ID NO: 691566 - DNA, 25 bp, Rattus norvegicus
tttctcctcaagtgcactgagtgtc

SEQ ID NO: 691567 - DNA, 25 bp, Rattus norvegicus
tttctcctcctcaggtgggttaata

SEQ ID NO: 691568 - DNA, 25 bp, Rattus norvegicus
tttctcctcctctggtgggttaata

SEQ ID NO: 691569 - DNA, 25 bp, Rattus norvegicus
tttctcctcgcgcaacaatggacag

SEQ ID NO: 691570 - DNA, 25 bp, Rattus norvegicus
tttctcctcgcggaacaatggacag

SEQ ID NO: 691571 - DNA, 25 bp, Rattus norvegicus
tttctcctctgaccaaagggcctgg

SEQ ID NO: 691572 - DNA, 25 bp, Rattus norvegicus
tttctcctctgagcaaagggcctgg

SEQ ID NO: 691573 - DNA, 25 bp, Rattus norvegicus
tttctcctctggatgttttgtttgt

SEQ ID NO: 691574 - DNA, 25 bp, Rattus norvegicus
tttctcctctggttgttttgtttgt

SEQ ID NO: 691575 - DNA, 25 bp, Rattus norvegicus
tttctcctcttgacatcattggttt

SEQ ID NO: 691576 - DNA, 25 bp, Rattus norvegicus
tttctcctcttgtcatcattggttt

SEQ ID NO: 691577 - DNA, 25 bp, Rattus norvegicus
tttctcctctttctatgttatggaa

SEQ ID NO: 691578 - DNA, 25 bp, Rattus norvegicus
tttctcctctttgtatgttatggaa

SEQ ID NO: 691579 - DNA, 25 bp, Rattus norvegicus
tttctcctgaacagaagcagacgat

SEQ ID NO: 691580 - DNA, 25 bp, Rattus norvegicus
tttctcctgaacatgtacggcaaca

SEQ ID NO: 691581 - DNA, 25 bp, Rattus norvegicus
tttctcctgaactgaagcagacgat

SEQ ID NO: 691582 - DNA, 25 bp, Rattus norvegicus
tttctcctgaacttgtacggcaaca

SEQ ID NO: 691583 - DNA, 25 bp, Rattus norvegicus
tttctcctgcaaagaaacagtttgt

SEQ ID NO: 691584 - DNA, 25 bp, Rattus norvegicus
tttctcctgcaatgaaacagtttgt

SEQ ID NO: 691585 - DNA, 25 bp, Rattus norvegicus
tttctcctgcccacaaacttagaaa

SEQ ID NO: 691586 - DNA, 25 bp, Rattus norvegicus
tttctcctgccctcaaacttagaaa

SEQ ID NO: 691587 - DNA, 25 bp, Rattus norvegicus
tttctcctgctaatcataccaaatc

SEQ ID NO: 691588 - DNA, 25 bp, Rattus norvegicus
tttctcctgctattcataccaaatc

SEQ ID NO: 691589 - DNA, 25 bp, Rattus norvegicus
tttctcctgctgaccacggaaaatc

SEQ ID NO: 691590 - DNA, 25 bp, Rattus norvegicus
tttctcctgctgtccacggaaaatc

SEQ ID NO: 691591 - DNA, 25 bp, Rattus norvegicus
tttctcctgcttcttaatagcctgg

SEQ ID NO: 691592 - DNA, 25 bp, Rattus norvegicus
tttctcctgcttgttaatagcctgg

SEQ ID NO: 691593 - DNA, 25 bp, Rattus norvegicus
tttctcctggagagactatttctgc

SEQ ID NO: 691594 - DNA, 25 bp, Rattus norvegicus
tttctcctggagtgactatttctgc

SEQ ID NO: 691595 - DNA, 25 bp, Rattus norvegicus
tttctcctggatattgtggttctgc

SEQ ID NO: 691596 - DNA, 25 bp, Rattus norvegicus
tttctcctggattttgtggttctgc

SEQ ID NO: 691597 - DNA, 25 bp, Rattus norvegicus
tttctccttacaccatatactccta

SEQ ID NO: 691598 - DNA, 25 bp, Rattus norvegicus
tttctccttacagcatatactccta

SEQ ID NO: 691599 - DNA, 25 bp, Rattus norvegicus
tttctccttaggacctcacacaatt

SEQ ID NO: 691600 - DNA, 25 bp, Rattus norvegicus
tttctccttaggtcctcacacaatt

SEQ ID NO: 691601 - DNA, 25 bp, Rattus norvegicus
tttctccttattaattcttgcccct

SEQ ID NO: 691602 - DNA, 25 bp, Rattus norvegicus
tttctccttatttattcttgcccct

SEQ ID NO: 691603 - DNA, 25 bp, Rattus norvegicus
tttctccttcctcatattagttatc

SEQ ID NO: 691604 - DNA, 25 bp, Rattus norvegicus
tttctccttcctgatattagttatc

SEQ ID NO: 691605 - DNA, 25 bp, Rattus norvegicus
tttctccttctacacactatgacaa

SEQ ID NO: 691606 - DNA, 25 bp, Rattus norvegicus
tttctccttctaccttgaagtcagt

SEQ ID NO: 691607 - DNA, 25 bp, Rattus norvegicus
tttctccttctagacactatgacaa

SEQ ID NO: 691608 - DNA, 25 bp, Rattus norvegicus
tttctccttctagcttgaagtcagt

SEQ ID NO: 691609 - DNA, 25 bp, Rattus norvegicus
tttctccttgccactttcattagtg

SEQ ID NO: 691610 - DNA, 25 bp, Rattus norvegicus
tttctccttgcctctttcattagtg

SEQ ID NO: 691611 - DNA, 25 bp, Rattus norvegicus
tttctccttggccataacttttaga

SEQ ID NO: 691612 - DNA, 25 bp, Rattus norvegicus
tttctccttggcgataacttttaga

SEQ ID NO: 691613 - DNA, 25 bp, Rattus norvegicus
tttctcctttagcaaggccagccat

SEQ ID NO: 691614 - DNA, 25 bp, Rattus norvegicus
tttctcctttaggaaggccagccat

SEQ ID NO: 691615 - DNA, 25 bp, Rattus norvegicus
tttctcctttctctgcagtccagga

SEQ ID NO: 691616 - DNA, 25 bp, Rattus norvegicus
tttctcctttctgtgcagtccagga

SEQ ID NO: 691617 - DNA, 25 bp, Rattus norvegicus
tttctcctttgcctgcggctcctta

SEQ ID NO: 691618 - DNA, 25 bp, Rattus norvegicus
tttctcctttgcgtgcggctcctta

SEQ ID NO: 691619 - DNA, 25 bp, Rattus norvegicus
tttctccttttccttcataactcat

SEQ ID NO: 691620 - DNA, 25 bp, Rattus norvegicus
tttctccttttcgttcataactcat

SEQ ID NO: 691621 - DNA, 25 bp, Rattus norvegicus
tttctcgcatccatttccatttttc

SEQ ID NO: 691622 - DNA, 25 bp, Rattus norvegicus
tttctcgcatccttttccatttttc

SEQ ID NO: 691623 - DNA, 25 bp, Rattus norvegicus
tttctcgctcttcattctgtttcaa

SEQ ID NO: 691624 - DNA, 25 bp, Rattus norvegicus
tttctcgctcttgattctgtttcaa

SEQ ID NO: 691625 - DNA, 25 bp, Rattus norvegicus
tttctcggacacaacttagagactt

SEQ ID NO: 691626 - DNA, 25 bp, Rattus norvegicus
tttctcggacactacttagagactt

SEQ ID NO: 691627 - DNA, 25 bp, Rattus norvegicus
tttctcgtcactcgcagcatggaag

SEQ ID NO: 691628 - DNA, 25 bp, Rattus norvegicus
tttctcgtcactggcagcatggaag

SEQ ID NO: 691629 - DNA, 25 bp, Rattus norvegicus
tttctcgtctatactgactggcaca

SEQ ID NO: 691630 - DNA, 25 bp, Rattus norvegicus
tttctcgtctattctgactggcaca

SEQ ID NO: 691631 - DNA, 25 bp, Rattus norvegicus
tttctcgtttccctggacactaaga

SEQ ID NO: 691632 - DNA, 25 bp, Rattus norvegicus
tttctcgtttccgtggacactaaga

SEQ ID NO: 691633 - DNA, 25 bp, Rattus norvegicus
tttctctaacatacttgtcgctctt

SEQ ID NO: 691634 - DNA, 25 bp, Rattus norvegicus
tttctctaacattcttgtcgctctt

SEQ ID NO: 691635 - DNA, 25 bp, Rattus norvegicus
tttctctaaccaccagccaaatcta

SEQ ID NO: 691636 - DNA, 25 bp, Rattus norvegicus
tttctctaaccagcagccaaatcta

SEQ ID NO: 691637 - DNA, 25 bp, Rattus norvegicus
tttctctaactccttgcttttcaaa

SEQ ID NO: 691638 - DNA, 25 bp, Rattus norvegicus
tttctctaactcgttgcttttcaaa

SEQ ID NO: 691639 - DNA, 25 bp, Rattus norvegicus
tttctctaagagattatctcaagac

SEQ ID NO: 691640 - DNA, 25 bp, Rattus norvegicus
tttctctaagagtttatctcaagac

SEQ ID NO: 691641 - DNA, 25 bp, Rattus norvegicus
tttctctaaggcctcagccagcagc

SEQ ID NO: 691642 - DNA, 25 bp, Rattus norvegicus
tttctctaaggcgtcagccagcagc

SEQ ID NO: 691643 - DNA, 25 bp, Rattus norvegicus
tttctctaatgtactggtgcttttc

SEQ ID NO: 691644 - DNA, 25 bp, Rattus norvegicus
tttctctaatgttctggtgcttttc

SEQ ID NO: 691645 - DNA, 25 bp, Rattus norvegicus
tttctctacatgctactgtacggta

SEQ ID NO: 691646 - DNA, 25 bp, Rattus norvegicus
tttctctacatggtactgtacggta

SEQ ID NO: 691647 - DNA, 25 bp, Rattus norvegicus
tttctctactgcagtcttccaggaa

SEQ ID NO: 691648 - DNA, 25 bp, Rattus norvegicus
tttctctactgctgtcttccaggaa

SEQ ID NO: 691649 - DNA, 25 bp, Rattus norvegicus
tttctctagagcctttgacccttaa

SEQ ID NO: 691650 - DNA, 25 bp, Rattus norvegicus
tttctctagagcgtttgacccttaa

SEQ ID NO: 691651 - DNA, 25 bp, Rattus norvegicus
tttctctagctccttattctatcca

SEQ ID NO: 691652 - DNA, 25 bp, Rattus norvegicus
tttctctagctcgttattctatcca

SEQ ID NO: 691653 - DNA, 25 bp, Rattus norvegicus
tttctctagcttacactggcagggc

SEQ ID NO: 691654 - DNA, 25 bp, Rattus norvegicus
tttctctagctttcactggcagggc

SEQ ID NO: 691655 - DNA, 25 bp, Rattus norvegicus
tttctctaggtaacacgcagctggc

SEQ ID NO: 691656 - DNA, 25 bp, Rattus norvegicus
tttctctaggtatcacgcagctggc

SEQ ID NO: 691657 - DNA, 25 bp, Rattus norvegicus
tttctctatattactgttcacttgt

SEQ ID NO: 691658 - DNA, 25 bp, Rattus norvegicus
tttctctatatttctgttcacttgt

SEQ ID NO: 691659 - DNA, 25 bp, Rattus norvegicus
tttctctatctcctccatttaggtc

SEQ ID NO: 691660 - DNA, 25 bp, Rattus norvegicus
tttctctatctcgtccatttaggtc

SEQ ID NO: 691661 - DNA, 25 bp, Rattus norvegicus
tttctctatggcctgattccagaag

SEQ ID NO: 691662 - DNA, 25 bp, Rattus norvegicus
tttctctatggcgtgattccagaag

SEQ ID NO: 691663 - DNA, 25 bp, Rattus norvegicus
tttctctattttactatccctgcat

SEQ ID NO: 691664 - DNA, 25 bp, Rattus norvegicus
tttctctatttttctatccctgcat

SEQ ID NO: 691665 - DNA, 25 bp, Rattus norvegicus
tttctctcaaaaaggttatcttcaa

SEQ ID NO: 691666 - DNA, 25 bp, Rattus norvegicus
tttctctcaaaatggttatcttcaa

SEQ ID NO: 691667 - DNA, 25 bp, Rattus norvegicus
tttctctcagagcacgatgccatat

SEQ ID NO: 691668 - DNA, 25 bp, Rattus norvegicus
tttctctcagaggacgatgccatat

SEQ ID NO: 691669 - DNA, 25 bp, Rattus norvegicus
tttctctcaggactggaaacctcta

SEQ ID NO: 691670 - DNA, 25 bp, Rattus norvegicus
tttctctcaggagtggaaacctcta

SEQ ID NO: 691671 - DNA, 25 bp, Rattus norvegicus
tttctctcatttcatcactctcaac

SEQ ID NO: 691672 - DNA, 25 bp, Rattus norvegicus
tttctctcatttgatcactctcaac

SEQ ID NO: 691673 - DNA, 25 bp, Rattus norvegicus
tttctctcccctatatggtacttct

SEQ ID NO: 691674 - DNA, 25 bp, Rattus norvegicus
tttctctcccctcgcatgggcatgg

SEQ ID NO: 691675 - DNA, 25 bp, Rattus norvegicus
tttctctcccctggcatgggcatgg

SEQ ID NO: 691676 - DNA, 25 bp, Rattus norvegicus
tttctctcccctttatggtacttct

SEQ ID NO: 691677 - DNA, 25 bp, Rattus norvegicus
tttctctcccgcacaaaaataaggt

SEQ ID NO: 691678 - DNA, 25 bp, Rattus norvegicus
tttctctcccgctcaaaaataaggt

SEQ ID NO: 691679 - DNA, 25 bp, Rattus norvegicus
tttctctccgttatcacctgtgaga

SEQ ID NO: 691680 - DNA, 25 bp, Rattus norvegicus
tttctctccgttctttctcaatttc

SEQ ID NO: 691681 - DNA, 25 bp, Rattus norvegicus
tttctctccgttgtttctcaatttc

SEQ ID NO: 691682 - DNA, 25 bp, Rattus norvegicus
tttctctccgttttcacctgtgaga

SEQ ID NO: 691683 - DNA, 25 bp, Rattus norvegicus
tttctctcctaccattgtacttcaa

SEQ ID NO: 691684 - DNA, 25 bp, Rattus norvegicus
tttctctcctacgattgtacttcaa

SEQ ID NO: 691685 - DNA, 25 bp, Rattus norvegicus
tttctctcctgcaattctgtattta

SEQ ID NO: 691686 - DNA, 25 bp, Rattus norvegicus
tttctctcctgctattctgtattta

SEQ ID NO: 691687 - DNA, 25 bp, Rattus norvegicus
tttctctcctggctaaggtgtggcc

SEQ ID NO: 691688 - DNA, 25 bp, Rattus norvegicus
tttctctcctggctggaaactgtag

SEQ ID NO: 691689 - DNA, 25 bp, Rattus norvegicus
tttctctcctgggtaaggtgtggcc

SEQ ID NO: 691690 - DNA, 25 bp, Rattus norvegicus
tttctctcctgggtggaaactgtag

SEQ ID NO: 691691 - DNA, 25 bp, Rattus norvegicus
tttctctctcagattgagagtgacc

SEQ ID NO: 691692 - DNA, 25 bp, Rattus norvegicus
tttctctctcagtttgagagtgacc

SEQ ID NO: 691693 - DNA, 25 bp, Rattus norvegicus
tttctctctccaagggctagatgaa

SEQ ID NO: 691694 - DNA, 25 bp, Rattus norvegicus
tttctctctccatgggctagatgaa

SEQ ID NO: 691695 - DNA, 25 bp, Rattus norvegicus
tttctctctcctcatgaggcagcat

SEQ ID NO: 691696 - DNA, 25 bp, Rattus norvegicus
tttctctctcctgatgaggcagcat

SEQ ID NO: 691697 - DNA, 25 bp, Rattus norvegicus
tttctctctctccatgtgagtgata

SEQ ID NO: 691698 - DNA, 25 bp, Rattus norvegicus
tttctctctctcgatgtgagtgata

SEQ ID NO: 691699 - DNA, 25 bp, Rattus norvegicus
tttctctctcttactggaatcaatg

SEQ ID NO: 691700 - DNA, 25 bp, Rattus norvegicus
tttctctctctttctggaatcaatg

SEQ ID NO: 691701 - DNA, 25 bp, Rattus norvegicus
tttctctctggaattttggttgcat

SEQ ID NO: 691702 - DNA, 25 bp, Rattus norvegicus
tttctctctggatttttggttgcat

SEQ ID NO: 691703 - DNA, 25 bp, Rattus norvegicus
tttctctctgttcttttggataatg

SEQ ID NO: 691704 - DNA, 25 bp, Rattus norvegicus
tttctctctgttgttttggataatg

SEQ ID NO: 691705 - DNA, 25 bp, Rattus norvegicus
tttctctcttctcatgggcaactga

SEQ ID NO: 691706 - DNA, 25 bp, Rattus norvegicus
tttctctcttctgatgggcaactga

SEQ ID NO: 691707 - DNA, 25 bp, Rattus norvegicus
tttctctgaagaccaactctagctt

SEQ ID NO: 691708 - DNA, 25 bp, Rattus norvegicus
tttctctgaagagcaactctagctt

SEQ ID NO: 691709 - DNA, 25 bp, Rattus norvegicus
tttctctgaccactgaatcgactcc

SEQ ID NO: 691710 - DNA, 25 bp, Rattus norvegicus
tttctctgaccagtgaatcgactcc

SEQ ID NO: 691711 - DNA, 25 bp, Rattus norvegicus
tttctctgacccatcagcacaataa

SEQ ID NO: 691712 - DNA, 25 bp, Rattus norvegicus
tttctctgacccttcagcacaataa

SEQ ID NO: 691713 - DNA, 25 bp, Rattus norvegicus
tttctctgacctattccatccttgg

SEQ ID NO: 691714 - DNA, 25 bp, Rattus norvegicus
tttctctgaccttttccatccttgg

SEQ ID NO: 691715 - DNA, 25 bp, Rattus norvegicus
tttctctgaggacccttaggactga

SEQ ID NO: 691716 - DNA, 25 bp, Rattus norvegicus
tttctctgaggagccttaggactga

SEQ ID NO: 691717 - DNA, 25 bp, Rattus norvegicus
tttctctgatcactatcaccacagg

SEQ ID NO: 691718 - DNA, 25 bp, Rattus norvegicus
tttctctgatcagtatcaccacagg

SEQ ID NO: 691719 - DNA, 25 bp, Rattus norvegicus
tttctctgccacaagcaaccagaaa

SEQ ID NO: 691720 - DNA, 25 bp, Rattus norvegicus
tttctctgccactagcaaccagaaa

SEQ ID NO: 691721 - DNA, 25 bp, Rattus norvegicus
tttctctgcccaacctagatgaaaa

SEQ ID NO: 691722 - DNA, 25 bp, Rattus norvegicus
tttctctgcccatcctagatgaaaa

SEQ ID NO: 691723 - DNA, 25 bp, Rattus norvegicus
tttctctgccgaccaggcggctcag

SEQ ID NO: 691724 - DNA, 25 bp, Rattus norvegicus
tttctctgccgagcaggcggctcag

SEQ ID NO: 691725 - DNA, 25 bp, Rattus norvegicus
tttctctgctgtatcagttcttgag

SEQ ID NO: 691726 - DNA, 25 bp, Rattus norvegicus
tttctctgctgtttcagttcttgag

SEQ ID NO: 691727 - DNA, 25 bp, Rattus norvegicus
tttctctgcttcacttgtctctgtc

SEQ ID NO: 691728 - DNA, 25 bp, Rattus norvegicus
tttctctgcttctcttgtctctgtc

SEQ ID NO: 691729 - DNA, 25 bp, Rattus norvegicus
tttctctggagcacatgtctgtgaa

SEQ ID NO: 691730 - DNA, 25 bp, Rattus norvegicus
tttctctggagctcatgtctgtgaa

SEQ ID NO: 691731 - DNA, 25 bp, Rattus norvegicus
tttctctggattcctggtcgttatg

SEQ ID NO: 691732 - DNA, 25 bp, Rattus norvegicus
tttctctggattgctggtcgttatg

SEQ ID NO: 691733 - DNA, 25 bp, Rattus norvegicus
tttctctggccaagcgacagtgtgt

SEQ ID NO: 691734 - DNA, 25 bp, Rattus norvegicus
tttctctggccatgcgacagtgtgt

SEQ ID NO: 691735 - DNA, 25 bp, Rattus norvegicus
tttctctggctgaaacgcttcttca

SEQ ID NO: 691736 - DNA, 25 bp, Rattus norvegicus
tttctctggctgtaacgcttcttca

SEQ ID NO: 691737 - DNA, 25 bp, Rattus norvegicus
tttctctggtgcaaacacaagtgct

SEQ ID NO: 691738 - DNA, 25 bp, Rattus norvegicus
tttctctggtgctaacacaagtgct

SEQ ID NO: 691739 - DNA, 25 bp, Rattus norvegicus
tttctctgtgccaatgtcaaacctt

SEQ ID NO: 691740 - DNA, 25 bp, Rattus norvegicus
tttctctgtgcctatgtcaaacctt

SEQ ID NO: 691741 - DNA, 25 bp, Rattus norvegicus
tttctctgtgctcggccgtaaaagg

SEQ ID NO: 691742 - DNA, 25 bp, Rattus norvegicus
tttctctgtgctgggccgtaaaagg

SEQ ID NO: 691743 - DNA, 25 bp, Rattus norvegicus
tttctctgtggaccgcttgcgttga

SEQ ID NO: 691744 - DNA, 25 bp, Rattus norvegicus
tttctctgtggagcgcttgcgttga

SEQ ID NO: 691745 - DNA, 25 bp, Rattus norvegicus
tttctctgtgttctaatcttcctta

SEQ ID NO: 691746 - DNA, 25 bp, Rattus norvegicus
tttctctgtgttgtaatcttcctta

SEQ ID NO: 691747 - DNA, 25 bp, Rattus norvegicus
tttctctgttttaatccatcctggg

SEQ ID NO: 691748 - DNA, 25 bp, Rattus norvegicus
tttctctgttttcttctcaggagtt

SEQ ID NO: 691749 - DNA, 25 bp, Rattus norvegicus
tttctctgttttgttctcaggagtt

SEQ ID NO: 691750 - DNA, 25 bp, Rattus norvegicus
tttctctgtttttatccatcctggg

SEQ ID NO: 691751 - DNA, 25 bp, Rattus norvegicus
tttctcttaggtacaggctgagcag

SEQ ID NO: 691752 - DNA, 25 bp, Rattus norvegicus
tttctcttaggttcaggctgagcag

SEQ ID NO: 691753 - DNA, 25 bp, Rattus norvegicus
tttctcttcaatccattcgacacgg

SEQ ID NO: 691754 - DNA, 25 bp, Rattus norvegicus
tttctcttcaatgcattcgacacgg

SEQ ID NO: 691755 - DNA, 25 bp, Rattus norvegicus
tttctcttcacgagcgctagttgag

SEQ ID NO: 691756 - DNA, 25 bp, Rattus norvegicus
tttctcttcacgtgcgctagttgag

SEQ ID NO: 691757 - DNA, 25 bp, Rattus norvegicus
tttctcttcataactgctgcgtgtc

SEQ ID NO: 691758 - DNA, 25 bp, Rattus norvegicus
tttctcttcatatctgctgcgtgtc

SEQ ID NO: 691759 - DNA, 25 bp, Rattus norvegicus
tttctcttcattctttcctgagcaa

SEQ ID NO: 691760 - DNA, 25 bp, Rattus norvegicus
tttctcttcattgtttcctgagcaa

SEQ ID NO: 691761 - DNA, 25 bp, Rattus norvegicus
tttctcttccttcactgtctcaaga

SEQ ID NO: 691762 - DNA, 25 bp, Rattus norvegicus
tttctcttccttgactgtctcaaga

SEQ ID NO: 691763 - DNA, 25 bp, Rattus norvegicus
tttctcttctgcctgtgacttaaac

SEQ ID NO: 691764 - DNA, 25 bp, Rattus norvegicus
tttctcttctgcgtgtgacttaaac

SEQ ID NO: 691765 - DNA, 25 bp, Rattus norvegicus
tttctcttgctcacttgctggcctt

SEQ ID NO: 691766 - DNA, 25 bp, Rattus norvegicus
tttctcttgctctcttgctggcctt

SEQ ID NO: 691767 - DNA, 25 bp, Rattus norvegicus
tttctcttggatcggacctgaacac

SEQ ID NO: 691768 - DNA, 25 bp, Rattus norvegicus
tttctcttggatgggacctgaacac

SEQ ID NO: 691769 - DNA, 25 bp, Rattus norvegicus
tttctcttgggcagcttatcaatac

SEQ ID NO: 691770 - DNA, 25 bp, Rattus norvegicus
tttctcttgggctgcttatcaatac

SEQ ID NO: 691771 - DNA, 25 bp, Rattus norvegicus
tttctcttgtcaactctgtacacta

SEQ ID NO: 691772 - DNA, 25 bp, Rattus norvegicus
tttctcttgtcatctctgtacacta

SEQ ID NO: 691773 - DNA, 25 bp, Rattus norvegicus
tttctcttgtgactgtactccatgt

SEQ ID NO: 691774 - DNA, 25 bp, Rattus norvegicus
tttctcttgtgagtgtactccatgt

SEQ ID NO: 691775 - DNA, 25 bp, Rattus norvegicus
tttctcttgtgcacctgcattagaa

SEQ ID NO: 691776 - DNA, 25 bp, Rattus norvegicus
tttctcttgtgctcctgcattagaa

SEQ ID NO: 691777 - DNA, 25 bp, Rattus norvegicus
tttctctttcatacatactttccca

SEQ ID NO: 691778 - DNA, 25 bp, Rattus norvegicus
tttctctttcattcatactttccca

SEQ ID NO: 691779 - DNA, 25 bp, Rattus norvegicus
tttctctttgtaccactgctcacag

SEQ ID NO: 691780 - DNA, 25 bp, Rattus norvegicus
tttctctttgtagcactgctcacag

SEQ ID NO: 691781 - DNA, 25 bp, Rattus norvegicus
tttctctttgttagcccttgtatat

SEQ ID NO: 691782 - DNA, 25 bp, Rattus norvegicus
tttctctttgtttgcccttgtatat

SEQ ID NO: 691783 - DNA, 25 bp, Rattus norvegicus
tttctctttttgatacttgcctaac

SEQ ID NO: 691784 - DNA, 25 bp, Rattus norvegicus
tttctctttttgttacttgcctaac

SEQ ID NO: 691785 - DNA, 25 bp, Rattus norvegicus
tttctgaaagtgagactcggtctgc

SEQ ID NO: 691786 - DNA, 25 bp, Rattus norvegicus
tttctgaaagtgtgactcggtctgc

SEQ ID NO: 691787 - DNA, 25 bp, Rattus norvegicus
tttctgaaatacactctcctactac

SEQ ID NO: 691788 - DNA, 25 bp, Rattus norvegicus
tttctgaaatactctctcctactac

SEQ ID NO: 691789 - DNA, 25 bp, Rattus norvegicus
tttctgaagcgtcttaggcagccca

SEQ ID NO: 691790 - DNA, 25 bp, Rattus norvegicus
tttctgaagcgtgttaggcagccca

SEQ ID NO: 691791 - DNA, 25 bp, Rattus norvegicus
tttctgaagctcctgtatctccttg

SEQ ID NO: 691792 - DNA, 25 bp, Rattus norvegicus
tttctgaagctcgtgtatctccttg

SEQ ID NO: 691793 - DNA, 25 bp, Rattus norvegicus
tttctgaatttccatgtgtgctaaa

SEQ ID NO: 691794 - DNA, 25 bp, Rattus norvegicus
tttctgaatttcgatgtgtgctaaa

SEQ ID NO: 691795 - DNA, 25 bp, Rattus norvegicus
tttctgacaagcagcctcatagtgt

SEQ ID NO: 691796 - DNA, 25 bp, Rattus norvegicus
tttctgacaagctgcctcatagtgt

SEQ ID NO: 691797 - DNA, 25 bp, Rattus norvegicus
tttctgacacctaatcctgctgtat

SEQ ID NO: 691798 - DNA, 25 bp, Rattus norvegicus
tttctgacaccttatcctgctgtat

SEQ ID NO: 691799 - DNA, 25 bp, Rattus norvegicus
tttctgacagtaataggtgactgct

SEQ ID NO: 691800 - DNA, 25 bp, Rattus norvegicus
tttctgacagtattaggtgactgct

SEQ ID NO: 691801 - DNA, 25 bp, Rattus norvegicus
tttctgaccaaccagtgggcagcca

SEQ ID NO: 691802 - DNA, 25 bp, Rattus norvegicus
tttctgaccaacgagtgggcagcca

SEQ ID NO: 691803 - DNA, 25 bp, Rattus norvegicus
tttctgacgtcactaggcacttgca

SEQ ID NO: 691804 - DNA, 25 bp, Rattus norvegicus
tttctgacgtcagtaggcacttgca

SEQ ID NO: 691805 - DNA, 25 bp, Rattus norvegicus
tttctgactgaaatgccctgactag

SEQ ID NO: 691806 - DNA, 25 bp, Rattus norvegicus
tttctgactgaattgccctgactag

SEQ ID NO: 691807 - DNA, 25 bp, Rattus norvegicus
tttctgacttacatccctgggagga

SEQ ID NO: 691808 - DNA, 25 bp, Rattus norvegicus
tttctgacttacttccctgggagga

SEQ ID NO: 691809 - DNA, 25 bp, Rattus norvegicus
tttctgacttcaattgcccaagcct

SEQ ID NO: 691810 - DNA, 25 bp, Rattus norvegicus
tttctgacttcatttgcccaagcct

SEQ ID NO: 691811 - DNA, 25 bp, Rattus norvegicus
tttctgagagttctggcctctgtgc

SEQ ID NO: 691812 - DNA, 25 bp, Rattus norvegicus
tttctgagagttgtggcctctgtgc

SEQ ID NO: 691813 - DNA, 25 bp, Rattus norvegicus
tttctgagcagaaccgtccgagact

SEQ ID NO: 691814 - DNA, 25 bp, Rattus norvegicus
tttctgagcagatccgtccgagact

SEQ ID NO: 691815 - DNA, 25 bp, Rattus norvegicus
tttctgagctataaattgccatggt

SEQ ID NO: 691816 - DNA, 25 bp, Rattus norvegicus
tttctgagctattaattgccatggt

SEQ ID NO: 691817 - DNA, 25 bp, Rattus norvegicus
tttctgagcttcatcttgggtctgg

SEQ ID NO: 691818 - DNA, 25 bp, Rattus norvegicus
tttctgagcttcttcttgggtctgg

SEQ ID NO: 691819 - DNA, 25 bp, Rattus norvegicus
tttctgaggctacacctctttctac

SEQ ID NO: 691820 - DNA, 25 bp, Rattus norvegicus
tttctgaggctagacctctttctac

SEQ ID NO: 691821 - DNA, 25 bp, Rattus norvegicus
tttctgaggctcagtggccagctac

SEQ ID NO: 691822 - DNA, 25 bp, Rattus norvegicus
tttctgaggctctgtggccagctac

SEQ ID NO: 691823 - DNA, 25 bp, Rattus norvegicus
tttctgagttaaatagactatcttc

SEQ ID NO: 691824 - DNA, 25 bp, Rattus norvegicus
tttctgagttaattagactatcttc

SEQ ID NO: 691825 - DNA, 25 bp, Rattus norvegicus
tttctgagtttcagccctgtaaaag

SEQ ID NO: 691826 - DNA, 25 bp, Rattus norvegicus
tttctgagtttctgccctgtaaaag

SEQ ID NO: 691827 - DNA, 25 bp, Rattus norvegicus
tttctgatacgtctgctgctggctg

SEQ ID NO: 691828 - DNA, 25 bp, Rattus norvegicus
tttctgatacgtgtgctgctggctg

SEQ ID NO: 691829 - DNA, 25 bp, Rattus norvegicus
tttctgatcacacctgtgcacacac

SEQ ID NO: 691830 - DNA, 25 bp, Rattus norvegicus
tttctgatcacagctgtgcacacac

SEQ ID NO: 691831 - DNA, 25 bp, Rattus norvegicus
tttctgatctatatcgcctatggca

SEQ ID NO: 691832 - DNA, 25 bp, Rattus norvegicus
tttctgatctatttcgcctatggca

SEQ ID NO: 691833 - DNA, 25 bp, Rattus norvegicus
tttctgatgacaccagcaccgcaga

SEQ ID NO: 691834 - DNA, 25 bp, Rattus norvegicus
tttctgatgacagcagcaccgcaga

SEQ ID NO: 691835 - DNA, 25 bp, Rattus norvegicus
tttctgatgcacaaagcttgagatt

SEQ ID NO: 691836 - DNA, 25 bp, Rattus norvegicus
tttctgatgcactaagcttgagatt

SEQ ID NO: 691837 - DNA, 25 bp, Rattus norvegicus
tttctgattctcatccagtttcgtc

SEQ ID NO: 691838 - DNA, 25 bp, Rattus norvegicus
tttctgattctcttccagtttcgtc

SEQ ID NO: 691839 - DNA, 25 bp, Rattus norvegicus
tttctgattggtagcttgtagcctc

SEQ ID NO: 691840 - DNA, 25 bp, Rattus norvegicus
tttctgattggttgcttgtagcctc

SEQ ID NO: 691841 - DNA, 25 bp, Rattus norvegicus
tttctgattttgatagccctctggt

SEQ ID NO: 691842 - DNA, 25 bp, Rattus norvegicus
tttctgattttgttagccctctggt

SEQ ID NO: 691843 - DNA, 25 bp, Rattus norvegicus
tttctgcaagctacattcctcggtc

SEQ ID NO: 691844 - DNA, 25 bp, Rattus norvegicus
tttctgcaagcttcattcctcggtc

SEQ ID NO: 691845 - DNA, 25 bp, Rattus norvegicus
tttctgcacggccacatagtacaca

SEQ ID NO: 691846 - DNA, 25 bp, Rattus norvegicus
tttctgcacggcgacatagtacaca

SEQ ID NO: 691847 - DNA, 25 bp, Rattus norvegicus
tttctgcacgttaggagtcttgtat

SEQ ID NO: 691848 - DNA, 25 bp, Rattus norvegicus
tttctgcacgtttggagtcttgtat

SEQ ID NO: 691849 - DNA, 25 bp, Rattus norvegicus
tttctgcagaggcactgacagtctc

SEQ ID NO: 691850 - DNA, 25 bp, Rattus norvegicus
tttctgcagagggactgacagtctc

SEQ ID NO: 691851 - DNA, 25 bp, Rattus norvegicus
tttctgcagctcagtgagcggtcca

SEQ ID NO: 691852 - DNA, 25 bp, Rattus norvegicus
tttctgcagctctgtgagcggtcca

SEQ ID NO: 691853 - DNA, 25 bp, Rattus norvegicus
tttctgcaggctcagaaggccacgt

SEQ ID NO: 691854 - DNA, 25 bp, Rattus norvegicus
tttctgcaggctgagaaggccacgt

SEQ ID NO: 691855 - DNA, 25 bp, Rattus norvegicus
tttctgcagtggcaattatctaagg

SEQ ID NO: 691856 - DNA, 25 bp, Rattus norvegicus
tttctgcagtgggaattatctaagg

SEQ ID NO: 691857 - DNA, 25 bp, Rattus norvegicus
tttctgcatcagaggacatccacgt

SEQ ID NO: 691858 - DNA, 25 bp, Rattus norvegicus
tttctgcatcagtggacatccacgt

SEQ ID NO: 691859 - DNA, 25 bp, Rattus norvegicus
tttctgcattatattgagccaaggc

SEQ ID NO: 691860 - DNA, 25 bp, Rattus norvegicus
tttctgcattattttgagccaaggc

SEQ ID NO: 691861 - DNA, 25 bp, Rattus norvegicus
tttctgccaaagatgctcaccaagg

SEQ ID NO: 691862 - DNA, 25 bp, Rattus norvegicus
tttctgccaaagttgctcaccaagg

SEQ ID NO: 691863 - DNA, 25 bp, Rattus norvegicus
tttctgccagccagcacgtggacca

SEQ ID NO: 691864 - DNA, 25 bp, Rattus norvegicus
tttctgccagcctgcacgtggacca

SEQ ID NO: 691865 - DNA, 25 bp, Rattus norvegicus
tttctgcccacaacataccaaaagt

SEQ ID NO: 691866 - DNA, 25 bp, Rattus norvegicus
tttctgcccacatcataccaaaagt

SEQ ID NO: 691867 - DNA, 25 bp, Rattus norvegicus
tttctgccgcagaacactcatggcg

SEQ ID NO: 691868 - DNA, 25 bp, Rattus norvegicus
tttctgccgcagtacactcatggcg

SEQ ID NO: 691869 - DNA, 25 bp, Rattus norvegicus
tttctgcctcctactaaaatgctgt

SEQ ID NO: 691870 - DNA, 25 bp, Rattus norvegicus
tttctgcctccttctaaaatgctgt

SEQ ID NO: 691871 - DNA, 25 bp, Rattus norvegicus
tttctgcctgccagtcagagttgtc

SEQ ID NO: 691872 - DNA, 25 bp, Rattus norvegicus
tttctgcctgcctgtcagagttgtc

SEQ ID NO: 691873 - DNA, 25 bp, Rattus norvegicus
tttctgcctgtgacattctgtgata

SEQ ID NO: 691874 - DNA, 25 bp, Rattus norvegicus
tttctgcctgtgactgctttatttt

SEQ ID NO: 691875 - DNA, 25 bp, Rattus norvegicus
tttctgcctgtgtcattctgtgata

SEQ ID NO: 691876 - DNA, 25 bp, Rattus norvegicus
tttctgcctgtgtctgctttatttt

SEQ ID NO: 691877 - DNA, 25 bp, Rattus norvegicus
tttctgcggtcactggaggactcag

SEQ ID NO: 691878 - DNA, 25 bp, Rattus norvegicus
tttctgcggtcagtggaggactcag

SEQ ID NO: 691879 - DNA, 25 bp, Rattus norvegicus
tttctgcgtaaaccgtcaaaccgtt

SEQ ID NO: 691880 - DNA, 25 bp, Rattus norvegicus
tttctgcgtaaagcgtcaaaccgtt

SEQ ID NO: 691881 - DNA, 25 bp, Rattus norvegicus
tttctgctacagaggtatatattct

SEQ ID NO: 691882 - DNA, 25 bp, Rattus norvegicus
tttctgctacagtggtatatattct

SEQ ID NO: 691883 - DNA, 25 bp, Rattus norvegicus
tttctgctcacgaagcttagattcc

SEQ ID NO: 691884 - DNA, 25 bp, Rattus norvegicus
tttctgctcacgtagcttagattcc

SEQ ID NO: 691885 - DNA, 25 bp, Rattus norvegicus
tttctgctcagccacaactaatgta

SEQ ID NO: 691886 - DNA, 25 bp, Rattus norvegicus
tttctgctcagcgacaactaatgta

SEQ ID NO: 691887 - DNA, 25 bp, Rattus norvegicus
tttctgctcaggctcggaagcaatt

SEQ ID NO: 691888 - DNA, 25 bp, Rattus norvegicus
tttctgctcagggtcggaagcaatt

SEQ ID NO: 691889 - DNA, 25 bp, Rattus norvegicus
tttctgctccagctgtcatgccgct

SEQ ID NO: 691890 - DNA, 25 bp, Rattus norvegicus
tttctgctccaggtgtcatgccgct

SEQ ID NO: 691891 - DNA, 25 bp, Rattus norvegicus
tttctgctgagtagttcaccccacc

SEQ ID NO: 691892 - DNA, 25 bp, Rattus norvegicus
tttctgctgagttgttcaccccacc

SEQ ID NO: 691893 - DNA, 25 bp, Rattus norvegicus
tttctgctgatgattatgtctgacc

SEQ ID NO: 691894 - DNA, 25 bp, Rattus norvegicus
tttctgctgatgtttatgtctgacc

SEQ ID NO: 691895 - DNA, 25 bp, Rattus norvegicus
tttctgctgctgcatgtgtatgtgt

SEQ ID NO: 691896 - DNA, 25 bp, Rattus norvegicus
tttctgctgctggatgtgtatgtgt

SEQ ID NO: 691897 - DNA, 25 bp, Rattus norvegicus
tttctgctggaaacaacggattatc

SEQ ID NO: 691898 - DNA, 25 bp, Rattus norvegicus
tttctgctggaatcaacggattatc

SEQ ID NO: 691899 - DNA, 25 bp, Rattus norvegicus
tttctgctggatctgtgtggtgtta

SEQ ID NO: 691900 - DNA, 25 bp, Rattus norvegicus
tttctgctggatgtgtgtggtgtta

SEQ ID NO: 691901 - DNA, 25 bp, Rattus norvegicus
tttctgcttagtacgagttcttcgg

SEQ ID NO: 691902 - DNA, 25 bp, Rattus norvegicus
tttctgcttagttcgagttcttcgg

SEQ ID NO: 691903 - DNA, 25 bp, Rattus norvegicus
tttctgcttccgcatttaacactca

SEQ ID NO: 691904 - DNA, 25 bp, Rattus norvegicus
tttctgcttccggatttaacactca

SEQ ID NO: 691905 - DNA, 25 bp, Rattus norvegicus
tttctgcttctgagccaatccaagg

SEQ ID NO: 691906 - DNA, 25 bp, Rattus norvegicus
tttctgcttctgtgccaatccaagg

SEQ ID NO: 691907 - DNA, 25 bp, Rattus norvegicus
tttctgcttcttacttcgttatcaa

SEQ ID NO: 691908 - DNA, 25 bp, Rattus norvegicus
tttctgcttcttcttgttggagtca

SEQ ID NO: 691909 - DNA, 25 bp, Rattus norvegicus
tttctgcttcttgttgttggagtca

SEQ ID NO: 691910 - DNA, 25 bp, Rattus norvegicus
tttctgcttctttcttcgttatcaa

SEQ ID NO: 691911 - DNA, 25 bp, Rattus norvegicus
tttctgcttgaaagatccaggatta

SEQ ID NO: 691912 - DNA, 25 bp, Rattus norvegicus
tttctgcttgaatgatccaggatta

SEQ ID NO: 691913 - DNA, 25 bp, Rattus norvegicus
tttctgcttgttctcaatgctccaa

SEQ ID NO: 691914 - DNA, 25 bp, Rattus norvegicus
tttctgcttgttgtcaatgctccaa

SEQ ID NO: 691915 - DNA, 25 bp, Rattus norvegicus
tttctgctttggctagagggctcat

SEQ ID NO: 691916 - DNA, 25 bp, Rattus norvegicus
tttctgctttgggtagagggctcat

SEQ ID NO: 691917 - DNA, 25 bp, Rattus norvegicus
tttctgcttttcatcttgtatttag

SEQ ID NO: 691918 - DNA, 25 bp, Rattus norvegicus
tttctgcttttcttcttgtatttag

SEQ ID NO: 691919 - DNA, 25 bp, Rattus norvegicus
tttctggaaaaactttgcctcttag

SEQ ID NO: 691920 - DNA, 25 bp, Rattus norvegicus
tttctggaaaaagtttgcctcttag

SEQ ID NO: 691921 - DNA, 25 bp, Rattus norvegicus
tttctggaacacaaggtctcctgtt

SEQ ID NO: 691922 - DNA, 25 bp, Rattus norvegicus
tttctggaacactaggtctcctgtt

SEQ ID NO: 691923 - DNA, 25 bp, Rattus norvegicus
tttctggaagacactcctacagtgg

SEQ ID NO: 691924 - DNA, 25 bp, Rattus norvegicus
tttctggaagactctcctacagtgg

SEQ ID NO: 691925 - DNA, 25 bp, Rattus norvegicus
tttctggaagtgatatattagggcc

SEQ ID NO: 691926 - DNA, 25 bp, Rattus norvegicus
tttctggaagtgttatattagggcc

SEQ ID NO: 691927 - DNA, 25 bp, Rattus norvegicus
tttctggaatgaccaaacgcccttc

SEQ ID NO: 691928 - DNA, 25 bp, Rattus norvegicus
tttctggaatgagcaaacgcccttc

SEQ ID NO: 691929 - DNA, 25 bp, Rattus norvegicus
tttctggactgacctcttggctaag

SEQ ID NO: 691930 - DNA, 25 bp, Rattus norvegicus
tttctggactgagctcttggctaag

SEQ ID NO: 691931 - DNA, 25 bp, Rattus norvegicus
tttctggaggctcacgttgggattc

SEQ ID NO: 691932 - DNA, 25 bp, Rattus norvegicus
tttctggaggctgacgttgggattc

SEQ ID NO: 691933 - DNA, 25 bp, Rattus norvegicus
tttctggatacaaactctgcctgag

SEQ ID NO: 691934 - DNA, 25 bp, Rattus norvegicus
tttctggatacatactctgcctgag

SEQ ID NO: 691935 - DNA, 25 bp, Rattus norvegicus
tttctggatccacctttcagcagtc

SEQ ID NO: 691936 - DNA, 25 bp, Rattus norvegicus
tttctggatccagctttcagcagtc

SEQ ID NO: 691937 - DNA, 25 bp, Rattus norvegicus
tttctggatgatatgcttttaactt

SEQ ID NO: 691938 - DNA, 25 bp, Rattus norvegicus
tttctggatgatttgcttttaactt

SEQ ID NO: 691939 - DNA, 25 bp, Rattus norvegicus
tttctggcagcacgcgtgtcaatgg

SEQ ID NO: 691940 - DNA, 25 bp, Rattus norvegicus
tttctggcagcaggcgtgtcaatgg

SEQ ID NO: 691941 - DNA, 25 bp, Rattus norvegicus
tttctggcaggcatttatgggcgtt

SEQ ID NO: 691942 - DNA, 25 bp, Rattus norvegicus
tttctggcaggcttttatgggcgtt

SEQ ID NO: 691943 - DNA, 25 bp, Rattus norvegicus
tttctggcctcgctgtggcaggaaa

SEQ ID NO: 691944 - DNA, 25 bp, Rattus norvegicus
tttctggcctcggtgtggcaggaaa

SEQ ID NO: 691945 - DNA, 25 bp, Rattus norvegicus
tttctggcctggcttgtttgcaaag

SEQ ID NO: 691946 - DNA, 25 bp, Rattus norvegicus
tttctggcctgggttgtttgcaaag

SEQ ID NO: 691947 - DNA, 25 bp, Rattus norvegicus
tttctggcctgtacctggatagcag

SEQ ID NO: 691948 - DNA, 25 bp, Rattus norvegicus
tttctggcctgttcctggatagcag

SEQ ID NO: 691949 - DNA, 25 bp, Rattus norvegicus
tttctggcgcccacatggtggatca

SEQ ID NO: 691950 - DNA, 25 bp, Rattus norvegicus
tttctggcgccctcatggtggatca

SEQ ID NO: 691951 - DNA, 25 bp, Rattus norvegicus
tttctggcggctcactggtacctgg

SEQ ID NO: 691952 - DNA, 25 bp, Rattus norvegicus
tttctggcggctgactggtacctgg

SEQ ID NO: 691953 - DNA, 25 bp, Rattus norvegicus
tttctggctagaaagttcgcccctt

SEQ ID NO: 691954 - DNA, 25 bp, Rattus norvegicus
tttctggctagatagttcgcccctt

SEQ ID NO: 691955 - DNA, 25 bp, Rattus norvegicus
tttctggctattagctgggacttct

SEQ ID NO: 691956 - DNA, 25 bp, Rattus norvegicus
tttctggctatttgctgggacttct

SEQ ID NO: 691957 - DNA, 25 bp, Rattus norvegicus
tttctggctgcacggtcgcttacgg

SEQ ID NO: 691958 - DNA, 25 bp, Rattus norvegicus
tttctggctgcagggtcgcttacgg

SEQ ID NO: 691959 - DNA, 25 bp, Rattus norvegicus
tttctggctgtaaaccctagacttg

SEQ ID NO: 691960 - DNA, 25 bp, Rattus norvegicus
tttctggctgtataccctagacttg

SEQ ID NO: 691961 - DNA, 25 bp, Rattus norvegicus
tttctgggaccaatagctgcatgaa

SEQ ID NO: 691962 - DNA, 25 bp, Rattus norvegicus
tttctgggaccattagctgcatgaa

SEQ ID NO: 691963 - DNA, 25 bp, Rattus norvegicus
tttctgggagaaacagggctctgac

SEQ ID NO: 691964 - DNA, 25 bp, Rattus norvegicus
tttctgggagaatcagggctctgac

SEQ ID NO: 691965 - DNA, 25 bp, Rattus norvegicus
tttctgggagccctgtttccctggg

SEQ ID NO: 691966 - DNA, 25 bp, Rattus norvegicus
tttctgggagccgtgtttccctggg

SEQ ID NO: 691967 - DNA, 25 bp, Rattus norvegicus
tttctgggagttatgtggcctcctt

SEQ ID NO: 691968 - DNA, 25 bp, Rattus norvegicus
tttctgggagttccgggctaacctg

SEQ ID NO: 691969 - DNA, 25 bp, Rattus norvegicus
tttctgggagttgcgggctaacctg

SEQ ID NO: 691970 - DNA, 25 bp, Rattus norvegicus
tttctgggagttttgtggcctcctt

SEQ ID NO: 691971 - DNA, 25 bp, Rattus norvegicus
tttctgggcactcaatccatcctga

SEQ ID NO: 691972 - DNA, 25 bp, Rattus norvegicus
tttctgggcactgaatccatcctga

SEQ ID NO: 691973 - DNA, 25 bp, Rattus norvegicus
tttctgggcatgctcaaagccctgg

SEQ ID NO: 691974 - DNA, 25 bp, Rattus norvegicus
tttctgggcatggtcaaagccctgg

SEQ ID NO: 691975 - DNA, 25 bp, Rattus norvegicus
tttctgggcctgaggtgacatgtag

SEQ ID NO: 691976 - DNA, 25 bp, Rattus norvegicus
tttctgggcctgtggtgacatgtag

SEQ ID NO: 691977 - DNA, 25 bp, Rattus norvegicus
tttctgggtccacgcaattgaggca

SEQ ID NO: 691978 - DNA, 25 bp, Rattus norvegicus
tttctgggtccaggcaattgaggca

SEQ ID NO: 691979 - DNA, 25 bp, Rattus norvegicus
tttctggtaataaggactgctggca

SEQ ID NO: 691980 - DNA, 25 bp, Rattus norvegicus
tttctggtaatatggactgctggca

SEQ ID NO: 691981 - DNA, 25 bp, Rattus norvegicus
tttctggtatcaacagctagcccca

SEQ ID NO: 691982 - DNA, 25 bp, Rattus norvegicus
tttctggtatcatcagctagcccca

SEQ ID NO: 691983 - DNA, 25 bp, Rattus norvegicus
tttctggtccatattgtgcaagcat

SEQ ID NO: 691984 - DNA, 25 bp, Rattus norvegicus
tttctggtccattttgtgcaagcat

SEQ ID NO: 691985 - DNA, 25 bp, Rattus norvegicus
tttctggtctgtacttcttgaccta

SEQ ID NO: 691986 - DNA, 25 bp, Rattus norvegicus
tttctggtctgttcttcttgaccta

SEQ ID NO: 691987 - DNA, 25 bp, Rattus norvegicus
tttctggtgaagaccaagcccggct

SEQ ID NO: 691988 - DNA, 25 bp, Rattus norvegicus
tttctggtgaagtccaagcccggct

SEQ ID NO: 691989 - DNA, 25 bp, Rattus norvegicus
tttctggtgctgataacttgtcttt

SEQ ID NO: 691990 - DNA, 25 bp, Rattus norvegicus
tttctggtgctgttaacttgtcttt

SEQ ID NO: 691991 - DNA, 25 bp, Rattus norvegicus
tttctggtgggcactgctgctctga

SEQ ID NO: 691992 - DNA, 25 bp, Rattus norvegicus
tttctggtgggctctgctgctctga

SEQ ID NO: 691993 - DNA, 25 bp, Rattus norvegicus
tttctggtggtaatcctgccgtgga

SEQ ID NO: 691994 - DNA, 25 bp, Rattus norvegicus
tttctggtggtattcctgccgtgga

SEQ ID NO: 691995 - DNA, 25 bp, Rattus norvegicus
tttctggttgctatgttctgatact

SEQ ID NO: 691996 - DNA, 25 bp, Rattus norvegicus
tttctggttgctttgttctgatact

SEQ ID NO: 691997 - DNA, 25 bp, Rattus norvegicus
tttctggtttgcattgctcttgatg

SEQ ID NO: 691998 - DNA, 25 bp, Rattus norvegicus
tttctggtttgctttgctcttgatg

SEQ ID NO: 691999 - DNA, 25 bp, Rattus norvegicus
tttctggtttggagagttctttaca

SEQ ID NO: 692000 - DNA, 25 bp, Rattus norvegicus
tttctggtttggtgagttctttaca

SEQ ID NO: 692001 - DNA, 25 bp, Rattus norvegicus
tttctgtaaccccttggaatgtgcc

SEQ ID NO: 692002 - DNA, 25 bp, Rattus norvegicus
tttctgtaacccgttggaatgtgcc

SEQ ID NO: 692003 - DNA, 25 bp, Rattus norvegicus
tttctgtacatgaagaatccataag

SEQ ID NO: 692004 - DNA, 25 bp, Rattus norvegicus
tttctgtacatgtagaatccataag

SEQ ID NO: 692005 - DNA, 25 bp, Rattus norvegicus
tttctgtacctcagactggcgagac

SEQ ID NO: 692006 - DNA, 25 bp, Rattus norvegicus
tttctgtacctctgactggcgagac

SEQ ID NO: 692007 - DNA, 25 bp, Rattus norvegicus
tttctgtatacacgtgggcacacgt

SEQ ID NO: 692008 - DNA, 25 bp, Rattus norvegicus
tttctgtatacaggtgggcacacgt

SEQ ID NO: 692009 - DNA, 25 bp, Rattus norvegicus
tttctgtattgtatcctcatgggac

SEQ ID NO: 692010 - DNA, 25 bp, Rattus norvegicus
tttctgtattgtttcctcatgggac

SEQ ID NO: 692011 - DNA, 25 bp, Rattus norvegicus
tttctgtatttgctgtgttccagct

SEQ ID NO: 692012 - DNA, 25 bp, Rattus norvegicus
tttctgtatttggtgtgttccagct

SEQ ID NO: 692013 - DNA, 25 bp, Rattus norvegicus
tttctgtcagaaaatggcattatac

SEQ ID NO: 692014 - DNA, 25 bp, Rattus norvegicus
tttctgtcagaatatggcattatac

SEQ ID NO: 692015 - DNA, 25 bp, Rattus norvegicus
tttctgtcagtgaaacgtccgcgtg

SEQ ID NO: 692016 - DNA, 25 bp, Rattus norvegicus
tttctgtcagtgtaacgtccgcgtg

SEQ ID NO: 692017 - DNA, 25 bp, Rattus norvegicus
tttctgtcatggacagggttgaact

SEQ ID NO: 692018 - DNA, 25 bp, Rattus norvegicus
tttctgtcatggtcagggttgaact

SEQ ID NO: 692019 - DNA, 25 bp, Rattus norvegicus
tttctgtccaatcctctccaagagc

SEQ ID NO: 692020 - DNA, 25 bp, Rattus norvegicus
tttctgtccaatgctctccaagagc

SEQ ID NO: 692021 - DNA, 25 bp, Rattus norvegicus
tttctgtcctgcagcactggaaggg

SEQ ID NO: 692022 - DNA, 25 bp, Rattus norvegicus
tttctgtcctgctgcactggaaggg

SEQ ID NO: 692023 - DNA, 25 bp, Rattus norvegicus
tttctgtcctgtacatgcactgaga

SEQ ID NO: 692024 - DNA, 25 bp, Rattus norvegicus
tttctgtcctgttcatgcactgaga

SEQ ID NO: 692025 - DNA, 25 bp, Rattus norvegicus
tttctgtccttacgccagtctcaaa

SEQ ID NO: 692026 - DNA, 25 bp, Rattus norvegicus
tttctgtccttaggccagtctcaaa

SEQ ID NO: 692027 - DNA, 25 bp, Rattus norvegicus
tttctgtctcaactcttcctataaa

SEQ ID NO: 692028 - DNA, 25 bp, Rattus norvegicus
tttctgtctcaagtcttcctataaa

SEQ ID NO: 692029 - DNA, 25 bp, Rattus norvegicus
tttctgtctcccaacaataaaattt

SEQ ID NO: 692030 - DNA, 25 bp, Rattus norvegicus
tttctgtctcccaacgaataggtgt

SEQ ID NO: 692031 - DNA, 25 bp, Rattus norvegicus
tttctgtctccctacaataaaattt

SEQ ID NO: 692032 - DNA, 25 bp, Rattus norvegicus
tttctgtctccctacgaataggtgt

SEQ ID NO: 692033 - DNA, 25 bp, Rattus norvegicus
tttctgtctcctacagtatgtgtct

SEQ ID NO: 692034 - DNA, 25 bp, Rattus norvegicus
tttctgtctccttcagtatgtgtct

SEQ ID NO: 692035 - DNA, 25 bp, Rattus norvegicus
tttctgtctctccatcttacaatga

SEQ ID NO: 692036 - DNA, 25 bp, Rattus norvegicus
tttctgtctctcgatcttacaatga

SEQ ID NO: 692037 - DNA, 25 bp, Rattus norvegicus
tttctgtctgtcacctgtgtactgg

SEQ ID NO: 692038 - DNA, 25 bp, Rattus norvegicus
tttctgtctgtctcctgtgtactgg

SEQ ID NO: 692039 - DNA, 25 bp, Rattus norvegicus
tttctgtgaaggctaaggcgctcca

SEQ ID NO: 692040 - DNA, 25 bp, Rattus norvegicus
tttctgtgaagggtaaggcgctcca

SEQ ID NO: 692041 - DNA, 25 bp, Rattus norvegicus
tttctgtgagctcataccccaggct

SEQ ID NO: 692042 - DNA, 25 bp, Rattus norvegicus
tttctgtgagctgataccccaggct

SEQ ID NO: 692043 - DNA, 25 bp, Rattus norvegicus
tttctgtgcaaactgtcccaggcaa

SEQ ID NO: 692044 - DNA, 25 bp, Rattus norvegicus
tttctgtgcaaagtgtcccaggcaa

SEQ ID NO: 692045 - DNA, 25 bp, Rattus norvegicus
tttctgtgcagacggttgttttgtt

SEQ ID NO: 692046 - DNA, 25 bp, Rattus norvegicus
tttctgtgcagagggttgttttgtt

SEQ ID NO: 692047 - DNA, 25 bp, Rattus norvegicus
tttctgtgcagcctaagtgttaaga

SEQ ID NO: 692048 - DNA, 25 bp, Rattus norvegicus
tttctgtgcagcgtaagtgttaaga

SEQ ID NO: 692049 - DNA, 25 bp, Rattus norvegicus
tttctgtgcatcatgatcgccaagc

SEQ ID NO: 692050 - DNA, 25 bp, Rattus norvegicus
tttctgtgcatcttgatcgccaagc

SEQ ID NO: 692051 - DNA, 25 bp, Rattus norvegicus
tttctgtgctccagcaaagtcctat

SEQ ID NO: 692052 - DNA, 25 bp, Rattus norvegicus
tttctgtgctcctgcaaagtcctat

SEQ ID NO: 692053 - DNA, 25 bp, Rattus norvegicus
tttctgtgcttgaaagacctctctt

SEQ ID NO: 692054 - DNA, 25 bp, Rattus norvegicus
tttctgtgcttgtaagacctctctt

SEQ ID NO: 692055 - DNA, 25 bp, Rattus norvegicus
tttctgtggactcctcaccatggaa

SEQ ID NO: 692056 - DNA, 25 bp, Rattus norvegicus
tttctgtggactgctcaccatggaa

SEQ ID NO: 692057 - DNA, 25 bp, Rattus norvegicus
tttctgtgtacaaccctgggattag

SEQ ID NO: 692058 - DNA, 25 bp, Rattus norvegicus
tttctgtgtacatccctgggattag

SEQ ID NO: 692059 - DNA, 25 bp, Rattus norvegicus
tttctgtgtcgtctgcttcttgaat

SEQ ID NO: 692060 - DNA, 25 bp, Rattus norvegicus
tttctgtgtcgtgtgcttcttgaat

SEQ ID NO: 692061 - DNA, 25 bp, Rattus norvegicus
tttctgtgtgcccacatgatgcaaa

SEQ ID NO: 692062 - DNA, 25 bp, Rattus norvegicus
tttctgtgtgccgacatgatgcaaa

SEQ ID NO: 692063 - DNA, 25 bp, Rattus norvegicus
tttctgtgtgtcatatgcgtgctac

SEQ ID NO: 692064 - DNA, 25 bp, Rattus norvegicus
tttctgtgtgtcttatgcgtgctac

SEQ ID NO: 692065 - DNA, 25 bp, Rattus norvegicus
tttctgtgttggcattgtcttctca

SEQ ID NO: 692066 - DNA, 25 bp, Rattus norvegicus
tttctgtgttgggattgtcttctca

SEQ ID NO: 692067 - DNA, 25 bp, Rattus norvegicus
tttctgttaaacaggctcctgtcaa

SEQ ID NO: 692068 - DNA, 25 bp, Rattus norvegicus
tttctgttaaactggctcctgtcaa

SEQ ID NO: 692069 - DNA, 25 bp, Rattus norvegicus
tttctgttagatcctgtcccgtgaa

SEQ ID NO: 692070 - DNA, 25 bp, Rattus norvegicus
tttctgttagatgctgtcccgtgaa

SEQ ID NO: 692071 - DNA, 25 bp, Rattus norvegicus
tttctgttagctcggagtcccagag

SEQ ID NO: 692072 - DNA, 25 bp, Rattus norvegicus
tttctgttagctgggagtcccagag

SEQ ID NO: 692073 - DNA, 25 bp, Rattus norvegicus
tttctgttcaatccatcatgcctga

SEQ ID NO: 692074 - DNA, 25 bp, Rattus norvegicus
tttctgttcaatgcatcatgcctga

SEQ ID NO: 692075 - DNA, 25 bp, Rattus norvegicus
tttctgttcgccatgttttgctgtg

SEQ ID NO: 692076 - DNA, 25 bp, Rattus norvegicus
tttctgttcgccttgttttgctgtg

SEQ ID NO: 692077 - DNA, 25 bp, Rattus norvegicus
tttctgttcgtgaggaatccagtga

SEQ ID NO: 692078 - DNA, 25 bp, Rattus norvegicus
tttctgttcgtgtggaatccagtga

SEQ ID NO: 692079 - DNA, 25 bp, Rattus norvegicus
tttctgttctcacaaggtcatccta

SEQ ID NO: 692080 - DNA, 25 bp, Rattus norvegicus
tttctgttctcagaaggtcatccta

SEQ ID NO: 692081 - DNA, 25 bp, Rattus norvegicus
tttctgttctgaataatgtgctgag

SEQ ID NO: 692082 - DNA, 25 bp, Rattus norvegicus
tttctgttctgattaatgtgctgag

SEQ ID NO: 692083 - DNA, 25 bp, Rattus norvegicus
tttctgttgaggacatcagtgacat

SEQ ID NO: 692084 - DNA, 25 bp, Rattus norvegicus
tttctgttgaggtcatcagtgacat

SEQ ID NO: 692085 - DNA, 25 bp, Rattus norvegicus
tttctgttgcttatccactgtgcca

SEQ ID NO: 692086 - DNA, 25 bp, Rattus norvegicus
tttctgttgcttttccactgtgcca

SEQ ID NO: 692087 - DNA, 25 bp, Rattus norvegicus
tttctgttggagctatgccagctgc

SEQ ID NO: 692088 - DNA, 25 bp, Rattus norvegicus
tttctgttggaggtatgccagctgc

SEQ ID NO: 692089 - DNA, 25 bp, Rattus norvegicus
tttctgttggctctcattgtcatct

SEQ ID NO: 692090 - DNA, 25 bp, Rattus norvegicus
tttctgttggctgtcattgtcatct

SEQ ID NO: 692091 - DNA, 25 bp, Rattus norvegicus
tttctgttgggtagcatgcttctat

SEQ ID NO: 692092 - DNA, 25 bp, Rattus norvegicus
tttctgttgggttgcatgcttctat

SEQ ID NO: 692093 - DNA, 25 bp, Rattus norvegicus
tttctgttgtgtaatttgcagtgca

SEQ ID NO: 692094 - DNA, 25 bp, Rattus norvegicus
tttctgttgtgttatttgcagtgca

SEQ ID NO: 692095 - DNA, 25 bp, Rattus norvegicus
tttctgtttattctatcttgcctgt

SEQ ID NO: 692096 - DNA, 25 bp, Rattus norvegicus
tttctgtttattgtatcttgcctgt

SEQ ID NO: 692097 - DNA, 25 bp, Rattus norvegicus
tttctgtttcacacattaacccact

SEQ ID NO: 692098 - DNA, 25 bp, Rattus norvegicus
tttctgtttcactcattaacccact

SEQ ID NO: 692099 - DNA, 25 bp, Rattus norvegicus
tttctgtttccccaagctgcaaaga

SEQ ID NO: 692100 - DNA, 25 bp, Rattus norvegicus
tttctgtttcccgaagctgcaaaga

SEQ ID NO: 692101 - DNA, 25 bp, Rattus norvegicus
tttctgtttccgacctagccagagc

SEQ ID NO: 692102 - DNA, 25 bp, Rattus norvegicus
tttctgtttccgtcctagccagagc

SEQ ID NO: 692103 - DNA, 25 bp, Rattus norvegicus
tttctgtttcctacatcctatactt

SEQ ID NO: 692104 - DNA, 25 bp, Rattus norvegicus
tttctgtttccttcatcctatactt

SEQ ID NO: 692105 - DNA, 25 bp, Rattus norvegicus
tttctgtttctcatactactggttt

SEQ ID NO: 692106 - DNA, 25 bp, Rattus norvegicus
tttctgtttctcttactactggttt

SEQ ID NO: 692107 - DNA, 25 bp, Rattus norvegicus
tttctgtttctgagctattctctga

SEQ ID NO: 692108 - DNA, 25 bp, Rattus norvegicus
tttctgtttctgatagccatggtct

SEQ ID NO: 692109 - DNA, 25 bp, Rattus norvegicus
tttctgtttctgtgctattctctga

SEQ ID NO: 692110 - DNA, 25 bp, Rattus norvegicus
tttctgtttctgttagccatggtct

SEQ ID NO: 692111 - DNA, 25 bp, Rattus norvegicus
tttctgtttgtcaggagtgctttca

SEQ ID NO: 692112 - DNA, 25 bp, Rattus norvegicus
tttctgtttgtcagtttcatataaa

SEQ ID NO: 692113 - DNA, 25 bp, Rattus norvegicus
tttctgtttgtctggagtgctttca

SEQ ID NO: 692114 - DNA, 25 bp, Rattus norvegicus
tttctgtttgtctgtttcatataaa

SEQ ID NO: 692115 - DNA, 25 bp, Rattus norvegicus
tttctgtttgttactagctgtcctt

SEQ ID NO: 692116 - DNA, 25 bp, Rattus norvegicus
tttctgtttgtttctagctgtcctt

SEQ ID NO: 692117 - DNA, 25 bp, Rattus norvegicus
tttctgttttatatccctgtacata

SEQ ID NO: 692118 - DNA, 25 bp, Rattus norvegicus
tttctgttttatttccctgtacata

SEQ ID NO: 692119 - DNA, 25 bp, Rattus norvegicus
tttctgtttttgactgttcctgtaa

SEQ ID NO: 692120 - DNA, 25 bp, Rattus norvegicus
tttctgtttttgtctgttcctgtaa

SEQ ID NO: 692121 - DNA, 25 bp, Rattus norvegicus
tttcttaaacccagtcttcgcctca

SEQ ID NO: 692122 - DNA, 25 bp, Rattus norvegicus
tttcttaaaccctgtcttcgcctca

SEQ ID NO: 692123 - DNA, 25 bp, Rattus norvegicus
tttcttaaattcatcctcagccatg

SEQ ID NO: 692124 - DNA, 25 bp, Rattus norvegicus
tttcttaaattcttcctcagccatg

SEQ ID NO: 692125 - DNA, 25 bp, Rattus norvegicus
tttcttaactgtcatcttctcactg

SEQ ID NO: 692126 - DNA, 25 bp, Rattus norvegicus
tttcttaactgtgatcttctcactg

SEQ ID NO: 692127 - DNA, 25 bp, Rattus norvegicus
tttcttaagaatccatccccaaata

SEQ ID NO: 692128 - DNA, 25 bp, Rattus norvegicus
tttcttaagaatgcatccccaaata

SEQ ID NO: 692129 - DNA, 25 bp, Rattus norvegicus
tttcttaagattaggagggctggca

SEQ ID NO: 692130 - DNA, 25 bp, Rattus norvegicus
tttcttaagatttggagggctggca

SEQ ID NO: 692131 - DNA, 25 bp, Rattus norvegicus
tttcttaagtttccacgtgggaaca

SEQ ID NO: 692132 - DNA, 25 bp, Rattus norvegicus
tttcttaagtttgcacgtgggaaca

SEQ ID NO: 692133 - DNA, 25 bp, Rattus norvegicus
tttcttaataaacggtgctatccct

SEQ ID NO: 692134 - DNA, 25 bp, Rattus norvegicus
tttcttaataaagggtgctatccct

SEQ ID NO: 692135 - DNA, 25 bp, Rattus norvegicus
tttcttacaccacgtttttctgccg

SEQ ID NO: 692136 - DNA, 25 bp, Rattus norvegicus
tttcttacaccaggtttttctgccg

SEQ ID NO: 692137 - DNA, 25 bp, Rattus norvegicus
tttcttacatgtatttctccctatc

SEQ ID NO: 692138 - DNA, 25 bp, Rattus norvegicus
tttcttacatgtttttctccctatc

SEQ ID NO: 692139 - DNA, 25 bp, Rattus norvegicus
tttcttactgcacctctcaaatgca

SEQ ID NO: 692140 - DNA, 25 bp, Rattus norvegicus
tttcttactgcagctctcaaatgca

SEQ ID NO: 692141 - DNA, 25 bp, Rattus norvegicus
tttcttactggcaagggttcttggt

SEQ ID NO: 692142 - DNA, 25 bp, Rattus norvegicus
tttcttactggctagggttcttggt

SEQ ID NO: 692143 - DNA, 25 bp, Rattus norvegicus
tttcttacttggacaaggccttact

SEQ ID NO: 692144 - DNA, 25 bp, Rattus norvegicus
tttcttacttggtcaaggccttact

SEQ ID NO: 692145 - DNA, 25 bp, Rattus norvegicus
tttcttagcgtaagggttctgtaca

SEQ ID NO: 692146 - DNA, 25 bp, Rattus norvegicus
tttcttagcgtatgggttctgtaca

SEQ ID NO: 692147 - DNA, 25 bp, Rattus norvegicus
tttcttaggaacaccctagtcccag

SEQ ID NO: 692148 - DNA, 25 bp, Rattus norvegicus
tttcttaggaactccctagtcccag

SEQ ID NO: 692149 - DNA, 25 bp, Rattus norvegicus
tttcttaggccacggaacagggtca

SEQ ID NO: 692150 - DNA, 25 bp, Rattus norvegicus
tttcttaggccagggaacagggtca

SEQ ID NO: 692151 - DNA, 25 bp, Rattus norvegicus
tttcttagttcgatttctcccgctg

SEQ ID NO: 692152 - DNA, 25 bp, Rattus norvegicus
tttcttagttcgttttctcccgctg

SEQ ID NO: 692153 - DNA, 25 bp, Rattus norvegicus
tttcttatagagatgtttcttacag

SEQ ID NO: 692154 - DNA, 25 bp, Rattus norvegicus
tttcttatagagttgtttcttacag

SEQ ID NO: 692155 - DNA, 25 bp, Rattus norvegicus
tttcttatgatcatgacccctaacc

SEQ ID NO: 692156 - DNA, 25 bp, Rattus norvegicus
tttcttatgatcttgacccctaacc

SEQ ID NO: 692157 - DNA, 25 bp, Rattus norvegicus
tttcttattagcctcattgtcctct

SEQ ID NO: 692158 - DNA, 25 bp, Rattus norvegicus
tttcttattagcgtcattgtcctct

SEQ ID NO: 692159 - DNA, 25 bp, Rattus norvegicus
tttcttcaaacgcactctcgggctt

SEQ ID NO: 692160 - DNA, 25 bp, Rattus norvegicus
tttcttcaaacggactctcgggctt

SEQ ID NO: 692161 - DNA, 25 bp, Rattus norvegicus
tttcttcacatgagtcttgtcctca

SEQ ID NO: 692162 - DNA, 25 bp, Rattus norvegicus
tttcttcacatgtgtcttgtcctca

SEQ ID NO: 692163 - DNA, 25 bp, Rattus norvegicus
tttcttcacctgacagtcatttgta

SEQ ID NO: 692164 - DNA, 25 bp, Rattus norvegicus
tttcttcacctgtcagtcatttgta

SEQ ID NO: 692165 - DNA, 25 bp, Rattus norvegicus
tttcttcacgttctggctgttttgc

SEQ ID NO: 692166 - DNA, 25 bp, Rattus norvegicus
tttcttcacgttgtggctgttttgc

SEQ ID NO: 692167 - DNA, 25 bp, Rattus norvegicus
tttcttcagaacatggaattacagc

SEQ ID NO: 692168 - DNA, 25 bp, Rattus norvegicus
tttcttcagaacttggaattacagc

SEQ ID NO: 692169 - DNA, 25 bp, Rattus norvegicus
tttcttcagatgacatggttgcaac

SEQ ID NO: 692170 - DNA, 25 bp, Rattus norvegicus
tttcttcagatgtcatggttgcaac

SEQ ID NO: 692171 - DNA, 25 bp, Rattus norvegicus
tttcttcagcctaactgtcctataa

SEQ ID NO: 692172 - DNA, 25 bp, Rattus norvegicus
tttcttcagccttactgtcctataa

SEQ ID NO: 692173 - DNA, 25 bp, Rattus norvegicus
tttcttcagtcaatcgccgggttta

SEQ ID NO: 692174 - DNA, 25 bp, Rattus norvegicus
tttcttcagtcattcgccgggttta

SEQ ID NO: 692175 - DNA, 25 bp, Rattus norvegicus
tttcttcagtctactattttgccag

SEQ ID NO: 692176 - DNA, 25 bp, Rattus norvegicus
tttcttcagtcttctattttgccag

SEQ ID NO: 692177 - DNA, 25 bp, Rattus norvegicus
tttcttcagtgactctgccatcgtc

SEQ ID NO: 692178 - DNA, 25 bp, Rattus norvegicus
tttcttcagtgagtctgccatcgtc

SEQ ID NO: 692179 - DNA, 25 bp, Rattus norvegicus
tttcttcagtttattaactcttcat

SEQ ID NO: 692180 - DNA, 25 bp, Rattus norvegicus
tttcttcagttttttaactcttcat

SEQ ID NO: 692181 - DNA, 25 bp, Rattus norvegicus
tttcttcatactattgctgccttgt

SEQ ID NO: 692182 - DNA, 25 bp, Rattus norvegicus
tttcttcatacttttgctgccttgt

SEQ ID NO: 692183 - DNA, 25 bp, Rattus norvegicus
tttcttcatggaaaatgagtacccc

SEQ ID NO: 692184 - DNA, 25 bp, Rattus norvegicus
tttcttcatggataatgagtacccc

SEQ ID NO: 692185 - DNA, 25 bp, Rattus norvegicus
tttcttcatgtcctgcagattctga

SEQ ID NO: 692186 - DNA, 25 bp, Rattus norvegicus
tttcttcatgtcgtgcagattctga

SEQ ID NO: 692187 - DNA, 25 bp, Rattus norvegicus
tttcttcattctaatgttcccgagc

SEQ ID NO: 692188 - DNA, 25 bp, Rattus norvegicus
tttcttcattcttatgttcccgagc

SEQ ID NO: 692189 - DNA, 25 bp, Rattus norvegicus
tttcttccaagcatcctgtcagatg

SEQ ID NO: 692190 - DNA, 25 bp, Rattus norvegicus
tttcttccaagcttcctgtcagatg

SEQ ID NO: 692191 - DNA, 25 bp, Rattus norvegicus
tttcttccagtccttagcggtcgta

SEQ ID NO: 692192 - DNA, 25 bp, Rattus norvegicus
tttcttccagtcgttagcggtcgta

SEQ ID NO: 692193 - DNA, 25 bp, Rattus norvegicus
tttcttcccagcattgtgactagtg

SEQ ID NO: 692194 - DNA, 25 bp, Rattus norvegicus
tttcttcccagctttgtgactagtg

SEQ ID NO: 692195 - DNA, 25 bp, Rattus norvegicus
tttcttcccatgatctgttgatcca

SEQ ID NO: 692196 - DNA, 25 bp, Rattus norvegicus
tttcttcccatgttctgttgatcca

SEQ ID NO: 692197 - DNA, 25 bp, Rattus norvegicus
tttcttccctcacgagagcagtttg

SEQ ID NO: 692198 - DNA, 25 bp, Rattus norvegicus
tttcttccctcaggagagcagtttg

SEQ ID NO: 692199 - DNA, 25 bp, Rattus norvegicus
tttcttccctcgagttcaactaaat

SEQ ID NO: 692200 - DNA, 25 bp, Rattus norvegicus
tttcttccctcgtgttcaactaaat

SEQ ID NO: 692201 - DNA, 25 bp, Rattus norvegicus
tttcttccctctcgacaaaggtcat

SEQ ID NO: 692202 - DNA, 25 bp, Rattus norvegicus
tttcttccctctggacaaaggtcat

SEQ ID NO: 692203 - DNA, 25 bp, Rattus norvegicus
tttcttccctggataagagcgtggt

SEQ ID NO: 692204 - DNA, 25 bp, Rattus norvegicus
tttcttccctggttaagagcgtggt

SEQ ID NO: 692205 - DNA, 25 bp, Rattus norvegicus
tttcttccgctgcatccaacggaac

SEQ ID NO: 692206 - DNA, 25 bp, Rattus norvegicus
tttcttccgctggatccaacggaac

SEQ ID NO: 692207 - DNA, 25 bp, Rattus norvegicus
tttcttcctaaacatacacatctcc

SEQ ID NO: 692208 - DNA, 25 bp, Rattus norvegicus
tttcttcctaaagatacacatctcc

SEQ ID NO: 692209 - DNA, 25 bp, Rattus norvegicus
tttcttcctatcaccttttcttgaa

SEQ ID NO: 692210 - DNA, 25 bp, Rattus norvegicus
tttcttcctatctccttttcttgaa

SEQ ID NO: 692211 - DNA, 25 bp, Rattus norvegicus
tttcttcctcttatgtaaaggcgat

SEQ ID NO: 692212 - DNA, 25 bp, Rattus norvegicus
tttcttcctcttttgtaaaggcgat

SEQ ID NO: 692213 - DNA, 25 bp, Rattus norvegicus
tttcttccttgcagttggtgtatac

SEQ ID NO: 692214 - DNA, 25 bp, Rattus norvegicus
tttcttccttgctgttggtgtatac

SEQ ID NO: 692215 - DNA, 25 bp, Rattus norvegicus
tttcttccttttcctggtgtcagcc

SEQ ID NO: 692216 - DNA, 25 bp, Rattus norvegicus
tttcttccttttgctggtgtcagcc

SEQ ID NO: 692217 - DNA, 25 bp, Rattus norvegicus
tttcttcgcagacttgtgtcttcaa

SEQ ID NO: 692218 - DNA, 25 bp, Rattus norvegicus
tttcttcgcagagttgtgtcttcaa

SEQ ID NO: 692219 - DNA, 25 bp, Rattus norvegicus
tttcttcgcccgagattagtgggct

SEQ ID NO: 692220 - DNA, 25 bp, Rattus norvegicus
tttcttcgcccgtgattagtgggct

SEQ ID NO: 692221 - DNA, 25 bp, Rattus norvegicus
tttcttcgttgtcgaaccagagatt

SEQ ID NO: 692222 - DNA, 25 bp, Rattus norvegicus
tttcttcgttgtggaaccagagatt

SEQ ID NO: 692223 - DNA, 25 bp, Rattus norvegicus
tttcttctagttctcagcctacagg

SEQ ID NO: 692224 - DNA, 25 bp, Rattus norvegicus
tttcttctagttgtcagcctacagg

SEQ ID NO: 692225 - DNA, 25 bp, Rattus norvegicus
tttcttctatccctctgtgtctgga

SEQ ID NO: 692226 - DNA, 25 bp, Rattus norvegicus
tttcttctatccgtctgtgtctgga

SEQ ID NO: 692227 - DNA, 25 bp, Rattus norvegicus
tttcttctattcatctgcctcattc

SEQ ID NO: 692228 - DNA, 25 bp, Rattus norvegicus
tttcttctattcttctgcctcattc

SEQ ID NO: 692229 - DNA, 25 bp, Rattus norvegicus
tttcttctcagcctgttaggtgggc

SEQ ID NO: 692230 - DNA, 25 bp, Rattus norvegicus
tttcttctcagcgtgttaggtgggc

SEQ ID NO: 692231 - DNA, 25 bp, Rattus norvegicus
tttcttctccacagtcagagcagaa

SEQ ID NO: 692232 - DNA, 25 bp, Rattus norvegicus
tttcttctccactgtcagagcagaa

SEQ ID NO: 692233 - DNA, 25 bp, Rattus norvegicus
tttcttctctcaatgctccacagta

SEQ ID NO: 692234 - DNA, 25 bp, Rattus norvegicus
tttcttctctcattgctccacagta

SEQ ID NO: 692235 - DNA, 25 bp, Rattus norvegicus
tttcttctctgtccacagatcagga

SEQ ID NO: 692236 - DNA, 25 bp, Rattus norvegicus
tttcttctctgtccctgtttgtttc

SEQ ID NO: 692237 - DNA, 25 bp, Rattus norvegicus
tttcttctctgtgcacagatcagga

SEQ ID NO: 692238 - DNA, 25 bp, Rattus norvegicus
tttcttctctgtgcctgtttgtttc

SEQ ID NO: 692239 - DNA, 25 bp, Rattus norvegicus
tttcttctcttaaccacttcaattg

SEQ ID NO: 692240 - DNA, 25 bp, Rattus norvegicus
tttcttctcttatccacttcaattg

SEQ ID NO: 692241 - DNA, 25 bp, Rattus norvegicus
tttcttctcttgaacaatactctga

SEQ ID NO: 692242 - DNA, 25 bp, Rattus norvegicus
tttcttctcttgtacaatactctga

SEQ ID NO: 692243 - DNA, 25 bp, Rattus norvegicus
tttcttctgaaacgctggacttcgc

SEQ ID NO: 692244 - DNA, 25 bp, Rattus norvegicus
tttcttctgaaaggctggacttcgc

SEQ ID NO: 692245 - DNA, 25 bp, Rattus norvegicus
tttcttctgacactcgggaatggga

SEQ ID NO: 692246 - DNA, 25 bp, Rattus norvegicus
tttcttctgacagtcgggaatggga

SEQ ID NO: 692247 - DNA, 25 bp, Rattus norvegicus
tttcttctgcctattaacttcactg

SEQ ID NO: 692248 - DNA, 25 bp, Rattus norvegicus
tttcttctgccttttaacttcactg

SEQ ID NO: 692249 - DNA, 25 bp, Rattus norvegicus
tttcttctggagagtaattcagtgt

SEQ ID NO: 692250 - DNA, 25 bp, Rattus norvegicus
tttcttctggagtgtaattcagtgt

SEQ ID NO: 692251 - DNA, 25 bp, Rattus norvegicus
tttcttctggtgagttaggtcctca

SEQ ID NO: 692252 - DNA, 25 bp, Rattus norvegicus
tttcttctggtgtgttaggtcctca

SEQ ID NO: 692253 - DNA, 25 bp, Rattus norvegicus
tttcttctgtctacaggcaggcact

SEQ ID NO: 692254 - DNA, 25 bp, Rattus norvegicus
tttcttctgtcttcaggcaggcact

SEQ ID NO: 692255 - DNA, 25 bp, Rattus norvegicus
tttcttctgttcaacacttcccaat

SEQ ID NO: 692256 - DNA, 25 bp, Rattus norvegicus
tttcttctgttctacacttcccaat

SEQ ID NO: 692257 - DNA, 25 bp, Rattus norvegicus
tttcttcttacccacctggaggact

SEQ ID NO: 692258 - DNA, 25 bp, Rattus norvegicus
tttcttcttaccgacctggaggact

SEQ ID NO: 692259 - DNA, 25 bp, Rattus norvegicus
tttcttcttactctggatgccatgt

SEQ ID NO: 692260 - DNA, 25 bp, Rattus norvegicus
tttcttcttactgtggatgccatgt

SEQ ID NO: 692261 - DNA, 25 bp, Rattus norvegicus
tttcttcttcccaaagagtgctgtc

SEQ ID NO: 692262 - DNA, 25 bp, Rattus norvegicus
tttcttcttcccatgtgaggtctgt

SEQ ID NO: 692263 - DNA, 25 bp, Rattus norvegicus
tttcttcttccctaagagtgctgtc

SEQ ID NO: 692264 - DNA, 25 bp, Rattus norvegicus
tttcttcttcccttgtgaggtctgt

SEQ ID NO: 692265 - DNA, 25 bp, Rattus norvegicus
tttcttcttctgacctcttagctgt

SEQ ID NO: 692266 - DNA, 25 bp, Rattus norvegicus
tttcttcttctgtcctcttagctgt

SEQ ID NO: 692267 - DNA, 25 bp, Rattus norvegicus
tttcttcttgagcaaaccagagcct

SEQ ID NO: 692268 - DNA, 25 bp, Rattus norvegicus
tttcttcttgaggaaaccagagcct

SEQ ID NO: 692269 - DNA, 25 bp, Rattus norvegicus
tttcttcttgcactaaggattgtca

SEQ ID NO: 692270 - DNA, 25 bp, Rattus norvegicus
tttcttcttgcagtaaggattgtca

SEQ ID NO: 692271 - DNA, 25 bp, Rattus norvegicus
tttcttcttgtcaccctcagtttaa

SEQ ID NO: 692272 - DNA, 25 bp, Rattus norvegicus
tttcttcttgtctccctcagtttaa

SEQ ID NO: 692273 - DNA, 25 bp, Rattus norvegicus
tttcttcttgttcctggtaaccaga

SEQ ID NO: 692274 - DNA, 25 bp, Rattus norvegicus
tttcttcttgttgctggtaaccaga

SEQ ID NO: 692275 - DNA, 25 bp, Rattus norvegicus
tttcttctttctctgggcgcaaaat

SEQ ID NO: 692276 - DNA, 25 bp, Rattus norvegicus
tttcttctttctgtgggcgcaaaat

SEQ ID NO: 692277 - DNA, 25 bp, Rattus norvegicus
tttcttctttggcatgtgccacttt

SEQ ID NO: 692278 - DNA, 25 bp, Rattus norvegicus
tttcttctttgggatgtgccacttt

SEQ ID NO: 692279 - DNA, 25 bp, Rattus norvegicus
tttcttcttttgcatctagtggcga

SEQ ID NO: 692280 - DNA, 25 bp, Rattus norvegicus
tttcttcttttggatctagtggcga

SEQ ID NO: 692281 - DNA, 25 bp, Rattus norvegicus
tttcttctttttccattctctctga

SEQ ID NO: 692282 - DNA, 25 bp, Rattus norvegicus
tttcttctttttctccatacaaaca

SEQ ID NO: 692283 - DNA, 25 bp, Rattus norvegicus
tttcttctttttgcattctctctga

SEQ ID NO: 692284 - DNA, 25 bp, Rattus norvegicus
tttcttctttttgtccatacaaaca

SEQ ID NO: 692285 - DNA, 25 bp, Rattus norvegicus
tttcttgacataatcagacatgctg

SEQ ID NO: 692286 - DNA, 25 bp, Rattus norvegicus
tttcttgacatattcagacatgctg

SEQ ID NO: 692287 - DNA, 25 bp, Rattus norvegicus
tttcttgaccacatatcttctttct

SEQ ID NO: 692288 - DNA, 25 bp, Rattus norvegicus
tttcttgaccacttatcttctttct

SEQ ID NO: 692289 - DNA, 25 bp, Rattus norvegicus
tttcttgaccggaatcagctcctac

SEQ ID NO: 692290 - DNA, 25 bp, Rattus norvegicus
tttcttgaccggtatcagctcctac

SEQ ID NO: 692291 - DNA, 25 bp, Rattus norvegicus
tttcttgaccttctaaagcagacgt

SEQ ID NO: 692292 - DNA, 25 bp, Rattus norvegicus
tttcttgaccttgtaaagcagacgt

SEQ ID NO: 692293 - DNA, 25 bp, Rattus norvegicus
tttcttgagactacatttccctatg

SEQ ID NO: 692294 - DNA, 25 bp, Rattus norvegicus
tttcttgagacttcatttccctatg

SEQ ID NO: 692295 - DNA, 25 bp, Rattus norvegicus
tttcttgagctgacgcccatgaagg

SEQ ID NO: 692296 - DNA, 25 bp, Rattus norvegicus
tttcttgagctgtcgcccatgaagg

SEQ ID NO: 692297 - DNA, 25 bp, Rattus norvegicus
tttcttgagtatcctttccccagtt

SEQ ID NO: 692298 - DNA, 25 bp, Rattus norvegicus
tttcttgagtatgctttccccagtt

SEQ ID NO: 692299 - DNA, 25 bp, Rattus norvegicus
tttcttgatacgcttgtcaccattt

SEQ ID NO: 692300 - DNA, 25 bp, Rattus norvegicus
tttcttgatacggttgtcaccattt

SEQ ID NO: 692301 - DNA, 25 bp, Rattus norvegicus
tttcttgatatgatggtcttcccct

SEQ ID NO: 692302 - DNA, 25 bp, Rattus norvegicus
tttcttgatatgttggtcttcccct

SEQ ID NO: 692303 - DNA, 25 bp, Rattus norvegicus
tttcttgcatggattggagctgatc

SEQ ID NO: 692304 - DNA, 25 bp, Rattus norvegicus
tttcttgcatggtttggagctgatc

SEQ ID NO: 692305 - DNA, 25 bp, Rattus norvegicus
tttcttgcccatattggtactgatg

SEQ ID NO: 692306 - DNA, 25 bp, Rattus norvegicus
tttcttgcccattttggtactgatg

SEQ ID NO: 692307 - DNA, 25 bp, Rattus norvegicus
tttcttgccttcctgattctgcttc

SEQ ID NO: 692308 - DNA, 25 bp, Rattus norvegicus
tttcttgccttcgtgattctgcttc

SEQ ID NO: 692309 - DNA, 25 bp, Rattus norvegicus
tttcttgccttgactgagcatggaa

SEQ ID NO: 692310 - DNA, 25 bp, Rattus norvegicus
tttcttgccttgtctgagcatggaa

SEQ ID NO: 692311 - DNA, 25 bp, Rattus norvegicus
tttcttgcgctcattttctctttct

SEQ ID NO: 692312 - DNA, 25 bp, Rattus norvegicus
tttcttgcgctctttttctctttct

SEQ ID NO: 692313 - DNA, 25 bp, Rattus norvegicus
tttcttgcggctctggagtaggacc

SEQ ID NO: 692314 - DNA, 25 bp, Rattus norvegicus
tttcttgcggctgtggagtaggacc

SEQ ID NO: 692315 - DNA, 25 bp, Rattus norvegicus
tttcttgctaggcttccttaggagc

SEQ ID NO: 692316 - DNA, 25 bp, Rattus norvegicus
tttcttgctagggttccttaggagc

SEQ ID NO: 692317 - DNA, 25 bp, Rattus norvegicus
tttcttgctggtacttttttactca

SEQ ID NO: 692318 - DNA, 25 bp, Rattus norvegicus
tttcttgctggttcttttttactca

SEQ ID NO: 692319 - DNA, 25 bp, Rattus norvegicus
tttcttggagccatctccagccagg

SEQ ID NO: 692320 - DNA, 25 bp, Rattus norvegicus
tttcttggagccttctccagccagg

SEQ ID NO: 692321 - DNA, 25 bp, Rattus norvegicus
tttcttggcaaaacagttcatctct

SEQ ID NO: 692322 - DNA, 25 bp, Rattus norvegicus
tttcttggcaaatcagttcatctct

SEQ ID NO: 692323 - DNA, 25 bp, Rattus norvegicus
tttcttggccatcttgttatctgac

SEQ ID NO: 692324 - DNA, 25 bp, Rattus norvegicus
tttcttggccatgttgttatctgac

SEQ ID NO: 692325 - DNA, 25 bp, Rattus norvegicus
tttcttggccctagcttgagcttga

SEQ ID NO: 692326 - DNA, 25 bp, Rattus norvegicus
tttcttggcccttgcttgagcttga

SEQ ID NO: 692327 - DNA, 25 bp, Rattus norvegicus
tttcttgggcgcaattttaatgatt

SEQ ID NO: 692328 - DNA, 25 bp, Rattus norvegicus
tttcttgggcgctattttaatgatt

SEQ ID NO: 692329 - DNA, 25 bp, Rattus norvegicus
tttcttgggtaaagggagtgtccag

SEQ ID NO: 692330 - DNA, 25 bp, Rattus norvegicus
tttcttgggtaatgggagtgtccag

SEQ ID NO: 692331 - DNA, 25 bp, Rattus norvegicus
tttcttggtacccaagtgtgctcac

SEQ ID NO: 692332 - DNA, 25 bp, Rattus norvegicus
tttcttggtaccgaagtgtgctcac

SEQ ID NO: 692333 - DNA, 25 bp, Rattus norvegicus
tttcttggtgtgatacctctggact

SEQ ID NO: 692334 - DNA, 25 bp, Rattus norvegicus
tttcttggtgtgttacctctggact

SEQ ID NO: 692335 - DNA, 25 bp, Rattus norvegicus
tttcttggttcaattgaaaaagtga

SEQ ID NO: 692336 - DNA, 25 bp, Rattus norvegicus
tttcttggttcatttgaaaaagtga

SEQ ID NO: 692337 - DNA, 25 bp, Rattus norvegicus
tttcttggtttcagagtctgaggcc

SEQ ID NO: 692338 - DNA, 25 bp, Rattus norvegicus
tttcttggtttctgagtctgaggcc

SEQ ID NO: 692339 - DNA, 25 bp, Rattus norvegicus
tttcttgtaccactgggatcctgct

SEQ ID NO: 692340 - DNA, 25 bp, Rattus norvegicus
tttcttgtaccagtgggatcctgct

SEQ ID NO: 692341 - DNA, 25 bp, Rattus norvegicus
tttcttgtagctcaggcaccttaaa

SEQ ID NO: 692342 - DNA, 25 bp, Rattus norvegicus
tttcttgtagctgaggcaccttaaa

SEQ ID NO: 692343 - DNA, 25 bp, Rattus norvegicus
tttcttgtatttactcaccatgtta

SEQ ID NO: 692344 - DNA, 25 bp, Rattus norvegicus
tttcttgtattttctcaccatgtta

SEQ ID NO: 692345 - DNA, 25 bp, Rattus norvegicus
tttcttgtcaccatttctaacctgt

SEQ ID NO: 692346 - DNA, 25 bp, Rattus norvegicus
tttcttgtcaccttttctaacctgt

SEQ ID NO: 692347 - DNA, 25 bp, Rattus norvegicus
tttcttgtccttacctggttcaaag

SEQ ID NO: 692348 - DNA, 25 bp, Rattus norvegicus
tttcttgtcctttcctggttcaaag

SEQ ID NO: 692349 - DNA, 25 bp, Rattus norvegicus
tttcttgtctatatttctttgctaa

SEQ ID NO: 692350 - DNA, 25 bp, Rattus norvegicus
tttcttgtctatttttctttgctaa

SEQ ID NO: 692351 - DNA, 25 bp, Rattus norvegicus
tttcttgtggcccaggtaccagctg

SEQ ID NO: 692352 - DNA, 25 bp, Rattus norvegicus
tttcttgtggccgaggtaccagctg

SEQ ID NO: 692353 - DNA, 25 bp, Rattus norvegicus
tttcttgttaacacttgccctaggt

SEQ ID NO: 692354 - DNA, 25 bp, Rattus norvegicus
tttcttgttaactcttgccctaggt

SEQ ID NO: 692355 - DNA, 25 bp, Rattus norvegicus
tttcttgttcaccagctttgatgta

SEQ ID NO: 692356 - DNA, 25 bp, Rattus norvegicus
tttcttgttcacgagctttgatgta

SEQ ID NO: 692357 - DNA, 25 bp, Rattus norvegicus
tttcttgttctgcaagccttcagga

SEQ ID NO: 692358 - DNA, 25 bp, Rattus norvegicus
tttcttgttctggaagccttcagga

SEQ ID NO: 692359 - DNA, 25 bp, Rattus norvegicus
tttcttgttgccctgtgtttggtca

SEQ ID NO: 692360 - DNA, 25 bp, Rattus norvegicus
tttcttgttgccgtgtgtttggtca

SEQ ID NO: 692361 - DNA, 25 bp, Rattus norvegicus
tttcttgtttgtcttctagggctca

SEQ ID NO: 692362 - DNA, 25 bp, Rattus norvegicus
tttcttgtttgtgttctagggctca

SEQ ID NO: 692363 - DNA, 25 bp, Rattus norvegicus
tttctttaatctcctacttctgcta

SEQ ID NO: 692364 - DNA, 25 bp, Rattus norvegicus
tttctttaatctcctcagttggaaa

SEQ ID NO: 692365 - DNA, 25 bp, Rattus norvegicus
tttctttaatctgctacttctgcta

SEQ ID NO: 692366 - DNA, 25 bp, Rattus norvegicus
tttctttaatctgctcagttggaaa

SEQ ID NO: 692367 - DNA, 25 bp, Rattus norvegicus
tttctttacaacaagttcagtcatg

SEQ ID NO: 692368 - DNA, 25 bp, Rattus norvegicus
tttctttacaactagttcagtcatg

SEQ ID NO: 692369 - DNA, 25 bp, Rattus norvegicus
tttctttacagaacaacaacccctc

SEQ ID NO: 692370 - DNA, 25 bp, Rattus norvegicus
tttctttacagatcaacaacccctc

SEQ ID NO: 692371 - DNA, 25 bp, Rattus norvegicus
tttctttacattaccttactttcag

SEQ ID NO: 692372 - DNA, 25 bp, Rattus norvegicus
tttctttacatttccttactttcag

SEQ ID NO: 692373 - DNA, 25 bp, Rattus norvegicus
tttctttaccctactgagctgttta

SEQ ID NO: 692374 - DNA, 25 bp, Rattus norvegicus
tttctttacccttctgagctgttta

SEQ ID NO: 692375 - DNA, 25 bp, Rattus norvegicus
tttctttactgtccaagggcccagg

SEQ ID NO: 692376 - DNA, 25 bp, Rattus norvegicus
tttctttactgtgcaagggcccagg

SEQ ID NO: 692377 - DNA, 25 bp, Rattus norvegicus
tttctttagccccttcattttgaat

SEQ ID NO: 692378 - DNA, 25 bp, Rattus norvegicus
tttctttagcccgttcattttgaat

SEQ ID NO: 692379 - DNA, 25 bp, Rattus norvegicus
tttctttatccccaggcaggtcctg

SEQ ID NO: 692380 - DNA, 25 bp, Rattus norvegicus
tttctttatcccgaggcaggtcctg

SEQ ID NO: 692381 - DNA, 25 bp, Rattus norvegicus
tttctttatgggagttttgcctgca

SEQ ID NO: 692382 - DNA, 25 bp, Rattus norvegicus
tttctttatgggtgttttgcctgca

SEQ ID NO: 692383 - DNA, 25 bp, Rattus norvegicus
tttctttattttactccttgagtct

SEQ ID NO: 692384 - DNA, 25 bp, Rattus norvegicus
tttctttatttttctccttgagtct

SEQ ID NO: 692385 - DNA, 25 bp, Rattus norvegicus
tttctttcacaacaacacacttcag

SEQ ID NO: 692386 - DNA, 25 bp, Rattus norvegicus
tttctttcacaagaacacacttcag

SEQ ID NO: 692387 - DNA, 25 bp, Rattus norvegicus
tttctttcatacacaatgatcccaa

SEQ ID NO: 692388 - DNA, 25 bp, Rattus norvegicus
tttctttcatactcaatgatcccaa

SEQ ID NO: 692389 - DNA, 25 bp, Rattus norvegicus
tttctttccataacggaagctcctc

SEQ ID NO: 692390 - DNA, 25 bp, Rattus norvegicus
tttctttccatatcggaagctcctc

SEQ ID NO: 692391 - DNA, 25 bp, Rattus norvegicus
tttctttcccctctacaagatgaaa

SEQ ID NO: 692392 - DNA, 25 bp, Rattus norvegicus
tttctttcccctgtacaagatgaaa

SEQ ID NO: 692393 - DNA, 25 bp, Rattus norvegicus
tttctttcccttcgcctaaatatag

SEQ ID NO: 692394 - DNA, 25 bp, Rattus norvegicus
tttctttcccttggcctaaatatag

SEQ ID NO: 692395 - DNA, 25 bp, Rattus norvegicus
tttctttccggccttcaaaagctgg

SEQ ID NO: 692396 - DNA, 25 bp, Rattus norvegicus
tttctttccggcgttcaaaagctgg

SEQ ID NO: 692397 - DNA, 25 bp, Rattus norvegicus
tttctttcctggagctgtgacctca

SEQ ID NO: 692398 - DNA, 25 bp, Rattus norvegicus
tttctttcctggtgctgtgacctca

SEQ ID NO: 692399 - DNA, 25 bp, Rattus norvegicus
tttctttccttaccagtattctgcc

SEQ ID NO: 692400 - DNA, 25 bp, Rattus norvegicus
tttctttccttagcagtattctgcc

SEQ ID NO: 692401 - DNA, 25 bp, Rattus norvegicus
tttctttctactccaggcctggttt

SEQ ID NO: 692402 - DNA, 25 bp, Rattus norvegicus
tttctttctactgcaggcctggttt

SEQ ID NO: 692403 - DNA, 25 bp, Rattus norvegicus
tttctttctccactgttctagttac

SEQ ID NO: 692404 - DNA, 25 bp, Rattus norvegicus
tttctttctccagtgttctagttac

SEQ ID NO: 692405 - DNA, 25 bp, Rattus norvegicus
tttctttctcccatttctggttgtg

SEQ ID NO: 692406 - DNA, 25 bp, Rattus norvegicus
tttctttctcccttttctggttgtg

SEQ ID NO: 692407 - DNA, 25 bp, Rattus norvegicus
tttctttcttcgctagcctaagata

SEQ ID NO: 692408 - DNA, 25 bp, Rattus norvegicus
tttctttcttcggtagcctaagata

SEQ ID NO: 692409 - DNA, 25 bp, Rattus norvegicus
tttctttgaatccacggaccagctg

SEQ ID NO: 692410 - DNA, 25 bp, Rattus norvegicus
tttctttgaatcgacggaccagctg

SEQ ID NO: 692411 - DNA, 25 bp, Rattus norvegicus
tttctttgacaaaacctaacttgcg

SEQ ID NO: 692412 - DNA, 25 bp, Rattus norvegicus
tttctttgacaatacctaacttgcg

SEQ ID NO: 692413 - DNA, 25 bp, Rattus norvegicus
tttctttgacaccatgattccttta

SEQ ID NO: 692414 - DNA, 25 bp, Rattus norvegicus
tttctttgacacgatgattccttta

SEQ ID NO: 692415 - DNA, 25 bp, Rattus norvegicus
tttctttgagtgattctcctgtctt

SEQ ID NO: 692416 - DNA, 25 bp, Rattus norvegicus
tttctttgagtgtttctcctgtctt

SEQ ID NO: 692417 - DNA, 25 bp, Rattus norvegicus
tttctttgccaaagcgatggccacc

SEQ ID NO: 692418 - DNA, 25 bp, Rattus norvegicus
tttctttgccaatgcgatggccacc

SEQ ID NO: 692419 - DNA, 25 bp, Rattus norvegicus
tttctttgctaaccctgctgcaagc

SEQ ID NO: 692420 - DNA, 25 bp, Rattus norvegicus
tttctttgctaagcctgctgcaagc

SEQ ID NO: 692421 - DNA, 25 bp, Rattus norvegicus
tttctttgcttcagagatcttgctg

SEQ ID NO: 692422 - DNA, 25 bp, Rattus norvegicus
tttctttgcttctgagatcttgctg

SEQ ID NO: 692423 - DNA, 25 bp, Rattus norvegicus
tttctttgctttatcaggctgtctg

SEQ ID NO: 692424 - DNA, 25 bp, Rattus norvegicus
tttctttgctttttcaggctgtctg

SEQ ID NO: 692425 - DNA, 25 bp, Rattus norvegicus
tttctttggccacaaccgttggact

SEQ ID NO: 692426 - DNA, 25 bp, Rattus norvegicus
tttctttggccagaaccgttggact

SEQ ID NO: 692427 - DNA, 25 bp, Rattus norvegicus
tttctttggtctatccaaccccatg

SEQ ID NO: 692428 - DNA, 25 bp, Rattus norvegicus
tttctttggtctttccaaccccatg

SEQ ID NO: 692429 - DNA, 25 bp, Rattus norvegicus
tttctttggtgtctgcttccagctc

SEQ ID NO: 692430 - DNA, 25 bp, Rattus norvegicus
tttctttggtgtgtgcttccagctc

SEQ ID NO: 692431 - DNA, 25 bp, Rattus norvegicus
tttctttgtagaagtggaccaccaa

SEQ ID NO: 692432 - DNA, 25 bp, Rattus norvegicus
tttctttgtagatgtggaccaccaa

SEQ ID NO: 692433 - DNA, 25 bp, Rattus norvegicus
tttctttgtgtaatgatggccttct

SEQ ID NO: 692434 - DNA, 25 bp, Rattus norvegicus
tttctttgtgtattgatggccttct

SEQ ID NO: 692435 - DNA, 25 bp, Rattus norvegicus
tttctttgtgtcaggtgtcttgtaa

SEQ ID NO: 692436 - DNA, 25 bp, Rattus norvegicus
tttctttgtgtctggtgtcttgtaa

SEQ ID NO: 692437 - DNA, 25 bp, Rattus norvegicus
tttctttgtttcagtggaccttgca

SEQ ID NO: 692438 - DNA, 25 bp, Rattus norvegicus
tttctttgtttctgtggaccttgca

SEQ ID NO: 692439 - DNA, 25 bp, Rattus norvegicus
tttcttttaaccagtatgtttacag

SEQ ID NO: 692440 - DNA, 25 bp, Rattus norvegicus
tttcttttaacctgtatgtttacag

SEQ ID NO: 692441 - DNA, 25 bp, Rattus norvegicus
tttcttttactcaaagccaggtgtg

SEQ ID NO: 692442 - DNA, 25 bp, Rattus norvegicus
tttcttttactctaagccaggtgtg

SEQ ID NO: 692443 - DNA, 25 bp, Rattus norvegicus
tttcttttagctccagtcactgaaa

SEQ ID NO: 692444 - DNA, 25 bp, Rattus norvegicus
tttcttttagctgcagtcactgaaa

SEQ ID NO: 692445 - DNA, 25 bp, Rattus norvegicus
tttcttttagttcccagctgaccaa

SEQ ID NO: 692446 - DNA, 25 bp, Rattus norvegicus
tttcttttagttgccagctgaccaa

SEQ ID NO: 692447 - DNA, 25 bp, Rattus norvegicus
tttcttttatacattcttgcttgtg

SEQ ID NO: 692448 - DNA, 25 bp, Rattus norvegicus
tttcttttatactttcttgcttgtg

SEQ ID NO: 692449 - DNA, 25 bp, Rattus norvegicus
tttcttttcaaaactgtggtactca

SEQ ID NO: 692450 - DNA, 25 bp, Rattus norvegicus
tttcttttcaaatctgtggtactca

SEQ ID NO: 692451 - DNA, 25 bp, Rattus norvegicus
tttcttttccagatgtctttgagaa

SEQ ID NO: 692452 - DNA, 25 bp, Rattus norvegicus
tttcttttccagttgtctttgagaa

SEQ ID NO: 692453 - DNA, 25 bp, Rattus norvegicus
tttcttttccgcaccttattgattg

SEQ ID NO: 692454 - DNA, 25 bp, Rattus norvegicus
tttcttttccgctccttattgattg

SEQ ID NO: 692455 - DNA, 25 bp, Rattus norvegicus
tttcttttcctcacatatctgatag

SEQ ID NO: 692456 - DNA, 25 bp, Rattus norvegicus
tttcttttcctctcatatctgatag

SEQ ID NO: 692457 - DNA, 25 bp, Rattus norvegicus
tttcttttctatcgtctttgtagtt

SEQ ID NO: 692458 - DNA, 25 bp, Rattus norvegicus
tttcttttctatggtctttgtagtt

SEQ ID NO: 692459 - DNA, 25 bp, Rattus norvegicus
tttcttttctcaaccacctgagaga

SEQ ID NO: 692460 - DNA, 25 bp, Rattus norvegicus
tttcttttctcaacctcaaggtcac

SEQ ID NO: 692461 - DNA, 25 bp, Rattus norvegicus
tttcttttctcatccacctgagaga

SEQ ID NO: 692462 - DNA, 25 bp, Rattus norvegicus
tttcttttctcatcctcaaggtcac

SEQ ID NO: 692463 - DNA, 25 bp, Rattus norvegicus
tttcttttctgcacagcttgcaaag

SEQ ID NO: 692464 - DNA, 25 bp, Rattus norvegicus
tttcttttctgctcagcttgcaaag

SEQ ID NO: 692465 - DNA, 25 bp, Rattus norvegicus
tttcttttcttcacttgctactcca

SEQ ID NO: 692466 - DNA, 25 bp, Rattus norvegicus
tttcttttcttctcttgctactcca

SEQ ID NO: 692467 - DNA, 25 bp, Rattus norvegicus
tttcttttgatgatttccacctgcc

SEQ ID NO: 692468 - DNA, 25 bp, Rattus norvegicus
tttcttttgatgttttccacctgcc

SEQ ID NO: 692469 - DNA, 25 bp, Rattus norvegicus
tttcttttgcgactgtctgcagctt

SEQ ID NO: 692470 - DNA, 25 bp, Rattus norvegicus
tttcttttgcgagtgtctgcagctt

SEQ ID NO: 692471 - DNA, 25 bp, Rattus norvegicus
tttcttttgcggagctgggaactga

SEQ ID NO: 692472 - DNA, 25 bp, Rattus norvegicus
tttcttttgcggtgctgggaactga

SEQ ID NO: 692473 - DNA, 25 bp, Rattus norvegicus
tttcttttggagcttggcatcgtca

SEQ ID NO: 692474 - DNA, 25 bp, Rattus norvegicus
tttcttttggaggttggcatcgtca

SEQ ID NO: 692475 - DNA, 25 bp, Rattus norvegicus
tttctttttacacagttttactgat

SEQ ID NO: 692476 - DNA, 25 bp, Rattus norvegicus
tttctttttacagagttttactgat

SEQ ID NO: 692477 - DNA, 25 bp, Rattus norvegicus
tttctttttcacacgtgtgatgcag

SEQ ID NO: 692478 - DNA, 25 bp, Rattus norvegicus
tttctttttcactcgtgtgatgcag

SEQ ID NO: 692479 - DNA, 25 bp, Rattus norvegicus
tttctttttccccattgctaatcat

SEQ ID NO: 692480 - DNA, 25 bp, Rattus norvegicus
tttctttttcccgattgctaatcat

SEQ ID NO: 692481 - DNA, 25 bp, Rattus norvegicus
tttctttttcctccactatctgtca

SEQ ID NO: 692482 - DNA, 25 bp, Rattus norvegicus
tttctttttcctgcactatctgtca

SEQ ID NO: 692483 - DNA, 25 bp, Rattus norvegicus
tttctttttcggctgatactgacag

SEQ ID NO: 692484 - DNA, 25 bp, Rattus norvegicus
tttctttttcgggtgatactgacag

SEQ ID NO: 692485 - DNA, 25 bp, Rattus norvegicus
tttctttttcttaggttctgcatta

SEQ ID NO: 692486 - DNA, 25 bp, Rattus norvegicus
tttctttttctttggttctgcatta

SEQ ID NO: 692487 - DNA, 25 bp, Rattus norvegicus
tttctttttgacagtcagccccact

SEQ ID NO: 692488 - DNA, 25 bp, Rattus norvegicus
tttctttttgactgtcagccccact

SEQ ID NO: 692489 - DNA, 25 bp, Rattus norvegicus
tttctttttggacctggagctgagc

SEQ ID NO: 692490 - DNA, 25 bp, Rattus norvegicus
tttctttttggagctggagctgagc

SEQ ID NO: 692491 - DNA, 25 bp, Rattus norvegicus
tttcttttttaaccttgccatcctc

SEQ ID NO: 692492 - DNA, 25 bp, Rattus norvegicus
tttcttttttaagcttgccatcctc

SEQ ID NO: 692493 - DNA, 25 bp, Rattus norvegicus
tttgaaaaccacacacttgcttcct

SEQ ID NO: 692494 - DNA, 25 bp, Rattus norvegicus
tttgaaaaccactcacttgcttcct

SEQ ID NO: 692495 - DNA, 25 bp, Rattus norvegicus
tttgaaaagaagaaccctccatggg

SEQ ID NO: 692496 - DNA, 25 bp, Rattus norvegicus
tttgaaaagaagtaccctccatggg

SEQ ID NO: 692497 - DNA, 25 bp, Rattus norvegicus
tttgaaaagcctctctcctgggccg

SEQ ID NO: 692498 - DNA, 25 bp, Rattus norvegicus
tttgaaaagcctgtctcctgggccg

SEQ ID NO: 692499 - DNA, 25 bp, Rattus norvegicus
tttgaaaatctgcaccttggacccg

SEQ ID NO: 692500 - DNA, 25 bp, Rattus norvegicus
tttgaaaatctggaccttggacccg

SEQ ID NO: 692501 - DNA, 25 bp, Rattus norvegicus
tttgaaaatggtctttcatccctct

SEQ ID NO: 692502 - DNA, 25 bp, Rattus norvegicus
tttgaaaatggtgtttcatccctct

SEQ ID NO: 692503 - DNA, 25 bp, Rattus norvegicus
tttgaaacaaaaagctccctcctgc

SEQ ID NO: 692504 - DNA, 25 bp, Rattus norvegicus
tttgaaacaaaatgctccctcctgc

SEQ ID NO: 692505 - DNA, 25 bp, Rattus norvegicus
tttgaaacgcgcacgtcccagtttg

SEQ ID NO: 692506 - DNA, 25 bp, Rattus norvegicus
tttgaaacgcgctcgtcccagtttg

SEQ ID NO: 692507 - DNA, 25 bp, Rattus norvegicus
tttgaaacggccctggcgacgcctc

SEQ ID NO: 692508 - DNA, 25 bp, Rattus norvegicus
tttgaaacggccgtggcgacgcctc

SEQ ID NO: 692509 - DNA, 25 bp, Rattus norvegicus
tttgaaagaaacatgtagcccaggc

SEQ ID NO: 692510 - DNA, 25 bp, Rattus norvegicus
tttgaaagaaacttgtagcccaggc

SEQ ID NO: 692511 - DNA, 25 bp, Rattus norvegicus
tttgaaagacaccaaattcccaggg

SEQ ID NO: 692512 - DNA, 25 bp, Rattus norvegicus
tttgaaagacacgaaattcccaggg

SEQ ID NO: 692513 - DNA, 25 bp, Rattus norvegicus
tttgaaagacccagctccgggagag

SEQ ID NO: 692514 - DNA, 25 bp, Rattus norvegicus
tttgaaagaccctgctccgggagag

SEQ ID NO: 692515 - DNA, 25 bp, Rattus norvegicus
tttgaaagataactggtccccagca

SEQ ID NO: 692516 - DNA, 25 bp, Rattus norvegicus
tttgaaagataagtggtccccagca

SEQ ID NO: 692517 - DNA, 25 bp, Rattus norvegicus
tttgaaagccaccttcgagattgcc

SEQ ID NO: 692518 - DNA, 25 bp, Rattus norvegicus
tttgaaagccacgttcgagattgcc

SEQ ID NO: 692519 - DNA, 25 bp, Rattus norvegicus
tttgaaagccatctccaccaatacg

SEQ ID NO: 692520 - DNA, 25 bp, Rattus norvegicus
tttgaaagccatgtccaccaatacg

SEQ ID NO: 692521 - DNA, 25 bp, Rattus norvegicus
tttgaaaggacaccatctcttcacc

SEQ ID NO: 692522 - DNA, 25 bp, Rattus norvegicus
tttgaaaggacagcatctcttcacc

SEQ ID NO: 692523 - DNA, 25 bp, Rattus norvegicus
tttgaaagggccatgggctgcccac

SEQ ID NO: 692524 - DNA, 25 bp, Rattus norvegicus
tttgaaagggccttgggctgcccac

SEQ ID NO: 692525 - DNA, 25 bp, Rattus norvegicus
tttgaaagtcccaccatatggtaat

SEQ ID NO: 692526 - DNA, 25 bp, Rattus norvegicus
tttgaaagtccctccatatggtaat

SEQ ID NO: 692527 - DNA, 25 bp, Rattus norvegicus
tttgaaatccccacaactccagaag

SEQ ID NO: 692528 - DNA, 25 bp, Rattus norvegicus
tttgaaatcccctcaactccagaag

SEQ ID NO: 692529 - DNA, 25 bp, Rattus norvegicus
tttgaaatgagacccttatttgatc

SEQ ID NO: 692530 - DNA, 25 bp, Rattus norvegicus
tttgaaatgagagccttatttgatc

SEQ ID NO: 692531 - DNA, 25 bp, Rattus norvegicus
tttgaaatgccgcaaatgcccagag

SEQ ID NO: 692532 - DNA, 25 bp, Rattus norvegicus
tttgaaatgccggaaatgcccagag

SEQ ID NO: 692533 - DNA, 25 bp, Rattus norvegicus
tttgaaatgtctcgccttatctgtt

SEQ ID NO: 692534 - DNA, 25 bp, Rattus norvegicus
tttgaaatgtctggccttatctgtt

SEQ ID NO: 692535 - DNA, 25 bp, Rattus norvegicus
tttgaacacttgacggttgtccctt

SEQ ID NO: 692536 - DNA, 25 bp, Rattus norvegicus
tttgaacacttgtcggttgtccctt

SEQ ID NO: 692537 - DNA, 25 bp, Rattus norvegicus
tttgaacagcccactcgggatggat

SEQ ID NO: 692538 - DNA, 25 bp, Rattus norvegicus
tttgaacagccctctcgggatggat

SEQ ID NO: 692539 - DNA, 25 bp, Rattus norvegicus
tttgaacagtataccagagatcaga

SEQ ID NO: 692540 - DNA, 25 bp, Rattus norvegicus
tttgaacagtattccagagatcaga

SEQ ID NO: 692541 - DNA, 25 bp, Rattus norvegicus
tttgaaccaagaacacgtcacccac

SEQ ID NO: 692542 - DNA, 25 bp, Rattus norvegicus
tttgaaccaagatcacgtcacccac

SEQ ID NO: 692543 - DNA, 25 bp, Rattus norvegicus
tttgaacccgaacctcctgctgtga

SEQ ID NO: 692544 - DNA, 25 bp, Rattus norvegicus
tttgaacccgaagctcctgctgtga

SEQ ID NO: 692545 - DNA, 25 bp, Rattus norvegicus
tttgaacgtgacattgcctctcgga

SEQ ID NO: 692546 - DNA, 25 bp, Rattus norvegicus
tttgaacgtgactttgcctctcgga

SEQ ID NO: 692547 - DNA, 25 bp, Rattus norvegicus
tttgaactaagtaccccgtgagtat

SEQ ID NO: 692548 - DNA, 25 bp, Rattus norvegicus
tttgaactaagttccccgtgagtat

SEQ ID NO: 692549 - DNA, 25 bp, Rattus norvegicus
tttgaactcagaccatacgtaccct

SEQ ID NO: 692550 - DNA, 25 bp, Rattus norvegicus
tttgaactcagagcatacgtaccct

SEQ ID NO: 692551 - DNA, 25 bp, Rattus norvegicus
tttgaactctcgactttagctggta

SEQ ID NO: 692552 - DNA, 25 bp, Rattus norvegicus
tttgaactctcgtctttagctggta

SEQ ID NO: 692553 - DNA, 25 bp, Rattus norvegicus
tttgaactgaaacccgacgtgcgca

SEQ ID NO: 692554 - DNA, 25 bp, Rattus norvegicus
tttgaactgaaagccgacgtgcgca

SEQ ID NO: 692555 - DNA, 25 bp, Rattus norvegicus
tttgaactgcagctcctcactacta

SEQ ID NO: 692556 - DNA, 25 bp, Rattus norvegicus
tttgaactgcaggtcctcactacta

SEQ ID NO: 692557 - DNA, 25 bp, Rattus norvegicus
tttgaactgctgccccgtaaccttt

SEQ ID NO: 692558 - DNA, 25 bp, Rattus norvegicus
tttgaactgctggcccgtaaccttt

SEQ ID NO: 692559 - DNA, 25 bp, Rattus norvegicus
tttgaactgggcatatttctctccc

SEQ ID NO: 692560 - DNA, 25 bp, Rattus norvegicus
tttgaactgggcttatttctctccc

SEQ ID NO: 692561 - DNA, 25 bp, Rattus norvegicus
tttgaactgtatccccagttacctc

SEQ ID NO: 692562 - DNA, 25 bp, Rattus norvegicus
tttgaactgtatgcccagttacctc

SEQ ID NO: 692563 - DNA, 25 bp, Rattus norvegicus
tttgaacttactacgttagtatcta

SEQ ID NO: 692564 - DNA, 25 bp, Rattus norvegicus
tttgaacttacttcgttagtatcta

SEQ ID NO: 692565 - DNA, 25 bp, Rattus norvegicus
tttgaacttctcaccctcatgagtg

SEQ ID NO: 692566 - DNA, 25 bp, Rattus norvegicus
tttgaacttctctccctcatgagtg

SEQ ID NO: 692567 - DNA, 25 bp, Rattus norvegicus
tttgaacttgacatcactgtgctca

SEQ ID NO: 692568 - DNA, 25 bp, Rattus norvegicus
tttgaacttgacttcactgtgctca

SEQ ID NO: 692569 - DNA, 25 bp, Rattus norvegicus
tttgaactttcaccactttctctct

SEQ ID NO: 692570 - DNA, 25 bp, Rattus norvegicus
tttgaactttcagcactttctctct

SEQ ID NO: 692571 - DNA, 25 bp, Rattus norvegicus
tttgaagaaagtcggcgggcatcat

SEQ ID NO: 692572 - DNA, 25 bp, Rattus norvegicus
tttgaagaaagtgggcgggcatcat

SEQ ID NO: 692573 - DNA, 25 bp, Rattus norvegicus
tttgaagacagaactgagccgcctg

SEQ ID NO: 692574 - DNA, 25 bp, Rattus norvegicus
tttgaagacagatctgagccgcctg

SEQ ID NO: 692575 - DNA, 25 bp, Rattus norvegicus
tttgaagacccactggctggagtcc

SEQ ID NO: 692576 - DNA, 25 bp, Rattus norvegicus
tttgaagacccagtggctggagtcc

SEQ ID NO: 692577 - DNA, 25 bp, Rattus norvegicus
tttgaagaccccatgctacagacag

SEQ ID NO: 692578 - DNA, 25 bp, Rattus norvegicus
tttgaagaccccttgctacagacag

SEQ ID NO: 692579 - DNA, 25 bp, Rattus norvegicus
tttgaagaccttcagttgctgctgg

SEQ ID NO: 692580 - DNA, 25 bp, Rattus norvegicus
tttgaagaccttgagttgctgctgg

SEQ ID NO: 692581 - DNA, 25 bp, Rattus norvegicus
tttgaagactttccacttcctgtcc

SEQ ID NO: 692582 - DNA, 25 bp, Rattus norvegicus
tttgaagactttccagcccaggttt

SEQ ID NO: 692583 - DNA, 25 bp, Rattus norvegicus
tttgaagactttgcacttcctgtcc

SEQ ID NO: 692584 - DNA, 25 bp, Rattus norvegicus
tttgaagactttgcagcccaggttt

SEQ ID NO: 692585 - DNA, 25 bp, Rattus norvegicus
tttgaagagaaaaccctcctcccag

SEQ ID NO: 692586 - DNA, 25 bp, Rattus norvegicus
tttgaagagaaatccctcctcccag

SEQ ID NO: 692587 - DNA, 25 bp, Rattus norvegicus
tttgaagagaccatggcccagagaa

SEQ ID NO: 692588 - DNA, 25 bp, Rattus norvegicus
tttgaagagaccttggcccagagaa

SEQ ID NO: 692589 - DNA, 25 bp, Rattus norvegicus
tttgaagagcatcgtgacctcaccc

SEQ ID NO: 692590 - DNA, 25 bp, Rattus norvegicus
tttgaagagcatggtgacctcaccc

SEQ ID NO: 692591 - DNA, 25 bp, Rattus norvegicus
tttgaagagccacatctcacctacc

SEQ ID NO: 692592 - DNA, 25 bp, Rattus norvegicus
tttgaagagccagatctcacctacc

SEQ ID NO: 692593 - DNA, 25 bp, Rattus norvegicus
tttgaagaggacaccgatgggcatt

SEQ ID NO: 692594 - DNA, 25 bp, Rattus norvegicus
tttgaagaggactccgatgggcatt

SEQ ID NO: 692595 - DNA, 25 bp, Rattus norvegicus
tttgaagatgctatcctgtcacacc

SEQ ID NO: 692596 - DNA, 25 bp, Rattus norvegicus
tttgaagatgctttcctgtcacacc

SEQ ID NO: 692597 - DNA, 25 bp, Rattus norvegicus
tttgaagattccagcagcaagcagc

SEQ ID NO: 692598 - DNA, 25 bp, Rattus norvegicus
tttgaagattcctgcagcaagcagc

SEQ ID NO: 692599 - DNA, 25 bp, Rattus norvegicus
tttgaagcactacaaacggcagctt

SEQ ID NO: 692600 - DNA, 25 bp, Rattus norvegicus
tttgaagcactagaaacggcagctt

SEQ ID NO: 692601 - DNA, 25 bp, Rattus norvegicus
tttgaagcagggattcactagctct

SEQ ID NO: 692602 - DNA, 25 bp, Rattus norvegicus
tttgaagcagggtttcactagctct

SEQ ID NO: 692603 - DNA, 25 bp, Rattus norvegicus
tttgaagccaaaacggaggatccct

SEQ ID NO: 692604 - DNA, 25 bp, Rattus norvegicus
tttgaagccaaatcggaggatccct

SEQ ID NO: 692605 - DNA, 25 bp, Rattus norvegicus
tttgaagccaatctgagacacactg

SEQ ID NO: 692606 - DNA, 25 bp, Rattus norvegicus
tttgaagccaatgtgagacacactg

SEQ ID NO: 692607 - DNA, 25 bp, Rattus norvegicus
tttgaagccactctgccactgtgtg

SEQ ID NO: 692608 - DNA, 25 bp, Rattus norvegicus
tttgaagccactgtgccactgtgtg

SEQ ID NO: 692609 - DNA, 25 bp, Rattus norvegicus
tttgaagccagcctactctacacag

SEQ ID NO: 692610 - DNA, 25 bp, Rattus norvegicus
tttgaagccagcgtactctacacag

SEQ ID NO: 692611 - DNA, 25 bp, Rattus norvegicus
tttgaagccaggagaacagaagcca

SEQ ID NO: 692612 - DNA, 25 bp, Rattus norvegicus
tttgaagccaggtgaacagaagcca

SEQ ID NO: 692613 - DNA, 25 bp, Rattus norvegicus
tttgaagccatccagagcgcgcagt

SEQ ID NO: 692614 - DNA, 25 bp, Rattus norvegicus
tttgaagccatcgagagcgcgcagt

SEQ ID NO: 692615 - DNA, 25 bp, Rattus norvegicus
tttgaagccggacttcttcctagca

SEQ ID NO: 692616 - DNA, 25 bp, Rattus norvegicus
tttgaagccggagttcttcctagca

SEQ ID NO: 692617 - DNA, 25 bp, Rattus norvegicus
tttgaagcctgtactgccgtgaaca

SEQ ID NO: 692618 - DNA, 25 bp, Rattus norvegicus
tttgaagcctgttctgccgtgaaca

SEQ ID NO: 692619 - DNA, 25 bp, Rattus norvegicus
tttgaagcgattatccctgggcaag

SEQ ID NO: 692620 - DNA, 25 bp, Rattus norvegicus
tttgaagcgattttccctgggcaag

SEQ ID NO: 692621 - DNA, 25 bp, Rattus norvegicus
tttgaagctcttcctctgatttcct

SEQ ID NO: 692622 - DNA, 25 bp, Rattus norvegicus
tttgaagctcttgctctgatttcct

SEQ ID NO: 692623 - DNA, 25 bp, Rattus norvegicus
tttgaagctgcacaatgggccacct

SEQ ID NO: 692624 - DNA, 25 bp, Rattus norvegicus
tttgaagctgcagaatgggccacct

SEQ ID NO: 692625 - DNA, 25 bp, Rattus norvegicus
tttgaagctgtcacttcttttccta

SEQ ID NO: 692626 - DNA, 25 bp, Rattus norvegicus
tttgaagctgtccaggctccaggaa

SEQ ID NO: 692627 - DNA, 25 bp, Rattus norvegicus
tttgaagctgtcgaggctccaggaa

SEQ ID NO: 692628 - DNA, 25 bp, Rattus norvegicus
tttgaagctgtctcttcttttccta

SEQ ID NO: 692629 - DNA, 25 bp, Rattus norvegicus
tttgaaggtctgcattcccgggcca

SEQ ID NO: 692630 - DNA, 25 bp, Rattus norvegicus
tttgaaggtctggattcccgggcca

SEQ ID NO: 692631 - DNA, 25 bp, Rattus norvegicus
tttgaaggttacacccgctcctggt

SEQ ID NO: 692632 - DNA, 25 bp, Rattus norvegicus
tttgaaggttactcccgctcctggt

SEQ ID NO: 692633 - DNA, 25 bp, Rattus norvegicus
tttgaagtacacatgcacacctaat

SEQ ID NO: 692634 - DNA, 25 bp, Rattus norvegicus
tttgaagtacacttgcacacctaat

SEQ ID NO: 692635 - DNA, 25 bp, Rattus norvegicus
tttgaagtccaactgaagcttttta

SEQ ID NO: 692636 - DNA, 25 bp, Rattus norvegicus
tttgaagtccaagtgaagcttttta

SEQ ID NO: 692637 - DNA, 25 bp, Rattus norvegicus
tttgaagtccccaattataacagag

SEQ ID NO: 692638 - DNA, 25 bp, Rattus norvegicus
tttgaagtcccctattataacagag

SEQ ID NO: 692639 - DNA, 25 bp, Rattus norvegicus
tttgaagtcgaaatcttccctcctg

SEQ ID NO: 692640 - DNA, 25 bp, Rattus norvegicus
tttgaagtcgaattcttccctcctg

SEQ ID NO: 692641 - DNA, 25 bp, Rattus norvegicus
tttgaagttcacatgcaactttttt

SEQ ID NO: 692642 - DNA, 25 bp, Rattus norvegicus
tttgaagttcacttgcaactttttt

SEQ ID NO: 692643 - DNA, 25 bp, Rattus norvegicus
tttgaagttcataatagcgatattg

SEQ ID NO: 692644 - DNA, 25 bp, Rattus norvegicus
tttgaagttcattatagcgatattg

SEQ ID NO: 692645 - DNA, 25 bp, Rattus norvegicus
tttgaagttttcaggtcacaacctc

SEQ ID NO: 692646 - DNA, 25 bp, Rattus norvegicus
tttgaagttttctggtcacaacctc

SEQ ID NO: 692647 - DNA, 25 bp, Rattus norvegicus
tttgaatactagatgtcaatctggg

SEQ ID NO: 692648 - DNA, 25 bp, Rattus norvegicus
tttgaatactagttgtcaatctggg

SEQ ID NO: 692649 - DNA, 25 bp, Rattus norvegicus
tttgaatagcgtcactcaggccatt

SEQ ID NO: 692650 - DNA, 25 bp, Rattus norvegicus
tttgaatagcgtgactcaggccatt

SEQ ID NO: 692651 - DNA, 25 bp, Rattus norvegicus
tttgaatatcatacctccagaagga

SEQ ID NO: 692652 - DNA, 25 bp, Rattus norvegicus
tttgaatatcattcctccagaagga

SEQ ID NO: 692653 - DNA, 25 bp, Rattus norvegicus
tttgaatatggcacttgcctgctca

SEQ ID NO: 692654 - DNA, 25 bp, Rattus norvegicus
tttgaatatggctcttgcctgctca

SEQ ID NO: 692655 - DNA, 25 bp, Rattus norvegicus
tttgaatcagtgctgacccttcaca

SEQ ID NO: 692656 - DNA, 25 bp, Rattus norvegicus
tttgaatcagtggtgacccttcaca

SEQ ID NO: 692657 - DNA, 25 bp, Rattus norvegicus
tttgaatccctgctgtgtatggcca

SEQ ID NO: 692658 - DNA, 25 bp, Rattus norvegicus
tttgaatccctggtgtgtatggcca

SEQ ID NO: 692659 - DNA, 25 bp, Rattus norvegicus
tttgaatcgctgactggcccggaac

SEQ ID NO: 692660 - DNA, 25 bp, Rattus norvegicus
tttgaatcgctgtctggcccggaac

SEQ ID NO: 692661 - DNA, 25 bp, Rattus norvegicus
tttgaatcggatccacctgctctgc

SEQ ID NO: 692662 - DNA, 25 bp, Rattus norvegicus
tttgaatcggatgcacctgctctgc

SEQ ID NO: 692663 - DNA, 25 bp, Rattus norvegicus
tttgaatcggttctactggcgctct

SEQ ID NO: 692664 - DNA, 25 bp, Rattus norvegicus
tttgaatcggttgtactggcgctct

SEQ ID NO: 692665 - DNA, 25 bp, Rattus norvegicus
tttgaatctcaaactgcctgcgcgg

SEQ ID NO: 692666 - DNA, 25 bp, Rattus norvegicus
tttgaatctcaatctgcctgcgcgg

SEQ ID NO: 692667 - DNA, 25 bp, Rattus norvegicus
tttgaatgcgttcttcctggttggt

SEQ ID NO: 692668 - DNA, 25 bp, Rattus norvegicus
tttgaatgcgttgttcctggttggt

SEQ ID NO: 692669 - DNA, 25 bp, Rattus norvegicus
tttgaatggcagacttagcccagcc

SEQ ID NO: 692670 - DNA, 25 bp, Rattus norvegicus
tttgaatggcagtcttagcccagcc

SEQ ID NO: 692671 - DNA, 25 bp, Rattus norvegicus
tttgaatgggatcagatgcagcgat

SEQ ID NO: 692672 - DNA, 25 bp, Rattus norvegicus
tttgaatgggatgagatgcagcgat

SEQ ID NO: 692673 - DNA, 25 bp, Rattus norvegicus
tttgaattagtcatcctgggtggga

SEQ ID NO: 692674 - DNA, 25 bp, Rattus norvegicus
tttgaattagtcttcctgggtggga

SEQ ID NO: 692675 - DNA, 25 bp, Rattus norvegicus
tttgaattatccacggtgtgtcacc

SEQ ID NO: 692676 - DNA, 25 bp, Rattus norvegicus
tttgaattatcctcggtgtgtcacc

SEQ ID NO: 692677 - DNA, 25 bp, Rattus norvegicus
tttgaattcatcatctgtaccccag

SEQ ID NO: 692678 - DNA, 25 bp, Rattus norvegicus
tttgaattcatcttctgtaccccag

SEQ ID NO: 692679 - DNA, 25 bp, Rattus norvegicus
tttgaattccaccttttccatgtca

SEQ ID NO: 692680 - DNA, 25 bp, Rattus norvegicus
tttgaattccacgttttccatgtca

SEQ ID NO: 692681 - DNA, 25 bp, Rattus norvegicus
tttgaattccagctcatgcctcagc

SEQ ID NO: 692682 - DNA, 25 bp, Rattus norvegicus
tttgaattccaggtcatgcctcagc

SEQ ID NO: 692683 - DNA, 25 bp, Rattus norvegicus
tttgaattctaactccagcctacac

SEQ ID NO: 692684 - DNA, 25 bp, Rattus norvegicus
tttgaattctaagtccagcctacac

SEQ ID NO: 692685 - DNA, 25 bp, Rattus norvegicus
tttgaatttagaaccctctggcagg

SEQ ID NO: 692686 - DNA, 25 bp, Rattus norvegicus
tttgaatttagatccctctggcagg

SEQ ID NO: 692687 - DNA, 25 bp, Rattus norvegicus
tttgaattttatctcttactgggct

SEQ ID NO: 692688 - DNA, 25 bp, Rattus norvegicus
tttgaattttatgtcttactgggct

SEQ ID NO: 692689 - DNA, 25 bp, Rattus norvegicus
tttgacaaagatcgcaaccggctgg

SEQ ID NO: 692690 - DNA, 25 bp, Rattus norvegicus
tttgacaaagatggcaaccggctgg

SEQ ID NO: 692691 - DNA, 25 bp, Rattus norvegicus
tttgacaagcttaaggatccgccca

SEQ ID NO: 692692 - DNA, 25 bp, Rattus norvegicus
tttgacaagctttaggatccgccca

SEQ ID NO: 692693 - DNA, 25 bp, Rattus norvegicus
tttgacacagatcctccccagaact

SEQ ID NO: 692694 - DNA, 25 bp, Rattus norvegicus
tttgacacagatgctccccagaact

SEQ ID NO: 692695 - DNA, 25 bp, Rattus norvegicus
tttgacaccaaccaaaaactacagg

SEQ ID NO: 692696 - DNA, 25 bp, Rattus norvegicus
tttgacaccaacgaaaaactacagg

SEQ ID NO: 692697 - DNA, 25 bp, Rattus norvegicus
tttgacaccatcatttggtctctgg

SEQ ID NO: 692698 - DNA, 25 bp, Rattus norvegicus
tttgacaccatcttttggtctctgg

SEQ ID NO: 692699 - DNA, 25 bp, Rattus norvegicus
tttgacaccccactgacttggtttt

SEQ ID NO: 692700 - DNA, 25 bp, Rattus norvegicus
tttgacaccccagtgacttggtttt

SEQ ID NO: 692701 - DNA, 25 bp, Rattus norvegicus
tttgacacccttccctaataacaca

SEQ ID NO: 692702 - DNA, 25 bp, Rattus norvegicus
tttgacacccttgcctaataacaca

SEQ ID NO: 692703 - DNA, 25 bp, Rattus norvegicus
tttgacactacgcacgtttatatgt

SEQ ID NO: 692704 - DNA, 25 bp, Rattus norvegicus
tttgacactacggacgtttatatgt

SEQ ID NO: 692705 - DNA, 25 bp, Rattus norvegicus
tttgacactgtaatcacaggtttga

SEQ ID NO: 692706 - DNA, 25 bp, Rattus norvegicus
tttgacactgtattcacaggtttga

SEQ ID NO: 692707 - DNA, 25 bp, Rattus norvegicus
tttgacacttatataacccgcccct

SEQ ID NO: 692708 - DNA, 25 bp, Rattus norvegicus
tttgacacttatttaacccgcccct

SEQ ID NO: 692709 - DNA, 25 bp, Rattus norvegicus
tttgacaggcatcacccttagagga

SEQ ID NO: 692710 - DNA, 25 bp, Rattus norvegicus
tttgacaggcatgacccttagagga

SEQ ID NO: 692711 - DNA, 25 bp, Rattus norvegicus
tttgacagtcctactactcaagctc

SEQ ID NO: 692712 - DNA, 25 bp, Rattus norvegicus
tttgacagtccttctactcaagctc

SEQ ID NO: 692713 - DNA, 25 bp, Rattus norvegicus
tttgacagtgtcaggctcacgactt

SEQ ID NO: 692714 - DNA, 25 bp, Rattus norvegicus
tttgacagtgtctggctcacgactt

SEQ ID NO: 692715 - DNA, 25 bp, Rattus norvegicus
tttgacatctgtcccgggcccagag

SEQ ID NO: 692716 - DNA, 25 bp, Rattus norvegicus
tttgacatctgtgccgggcccagag

SEQ ID NO: 692717 - DNA, 25 bp, Rattus norvegicus
tttgacatgtccaaagcacgctact

SEQ ID NO: 692718 - DNA, 25 bp, Rattus norvegicus
tttgacatgtcctaagcacgctact

SEQ ID NO: 692719 - DNA, 25 bp, Rattus norvegicus
tttgacattccacgttaaactgctg

SEQ ID NO: 692720 - DNA, 25 bp, Rattus norvegicus
tttgacattccaggttaaactgctg

SEQ ID NO: 692721 - DNA, 25 bp, Rattus norvegicus
tttgaccaagccaggaacctagttg

SEQ ID NO: 692722 - DNA, 25 bp, Rattus norvegicus
tttgaccaagcctggaacctagttg

SEQ ID NO: 692723 - DNA, 25 bp, Rattus norvegicus
tttgaccacagtagtcccaatcctg

SEQ ID NO: 692724 - DNA, 25 bp, Rattus norvegicus
tttgaccacagttgtcccaatcctg

SEQ ID NO: 692725 - DNA, 25 bp, Rattus norvegicus
tttgaccactgcaagtctgggccat

SEQ ID NO: 692726 - DNA, 25 bp, Rattus norvegicus
tttgaccactgctagtctgggccat

SEQ ID NO: 692727 - DNA, 25 bp, Rattus norvegicus
tttgaccagaggagggagcccagct

SEQ ID NO: 692728 - DNA, 25 bp, Rattus norvegicus
tttgaccagaggtgggagcccagct

SEQ ID NO: 692729 - DNA, 25 bp, Rattus norvegicus
tttgaccagatgaacactacctcct

SEQ ID NO: 692730 - DNA, 25 bp, Rattus norvegicus
tttgaccagatgtacactacctcct

SEQ ID NO: 692731 - DNA, 25 bp, Rattus norvegicus
tttgaccagggcaccgacgaagaga

SEQ ID NO: 692732 - DNA, 25 bp, Rattus norvegicus
tttgaccagggctccgacgaagaga

SEQ ID NO: 692733 - DNA, 25 bp, Rattus norvegicus
tttgaccagtcaactggcctctggc

SEQ ID NO: 692734 - DNA, 25 bp, Rattus norvegicus
tttgaccagtcatctggcctctggc

SEQ ID NO: 692735 - DNA, 25 bp, Rattus norvegicus
tttgaccagttcatcggagagcacc

SEQ ID NO: 692736 - DNA, 25 bp, Rattus norvegicus
tttgaccagttcttcggagagcacc

SEQ ID NO: 692737 - DNA, 25 bp, Rattus norvegicus
tttgacccaaacacttggagctcgg

SEQ ID NO: 692738 - DNA, 25 bp, Rattus norvegicus
tttgacccaaactcttggagctcgg

SEQ ID NO: 692739 - DNA, 25 bp, Rattus norvegicus
tttgacccactcatcttaggctttt

SEQ ID NO: 692740 - DNA, 25 bp, Rattus norvegicus
tttgacccactcttcttaggctttt

SEQ ID NO: 692741 - DNA, 25 bp, Rattus norvegicus
tttgaccccaataaggtggcacctt

SEQ ID NO: 692742 - DNA, 25 bp, Rattus norvegicus
tttgaccccaatcccaggacggtga

SEQ ID NO: 692743 - DNA, 25 bp, Rattus norvegicus
tttgaccccaatgccaggacggtga

SEQ ID NO: 692744 - DNA, 25 bp, Rattus norvegicus
tttgaccccaattaggtggcacctt

SEQ ID NO: 692745 - DNA, 25 bp, Rattus norvegicus
tttgaccctagactggatcacgaag

SEQ ID NO: 692746 - DNA, 25 bp, Rattus norvegicus
tttgaccctagagtggatcacgaag

SEQ ID NO: 692747 - DNA, 25 bp, Rattus norvegicus
tttgaccctcagactggcaagtact

SEQ ID NO: 692748 - DNA, 25 bp, Rattus norvegicus
tttgaccctcagtctggcaagtact

SEQ ID NO: 692749 - DNA, 25 bp, Rattus norvegicus
tttgaccctgatcatattatgccct

SEQ ID NO: 692750 - DNA, 25 bp, Rattus norvegicus
tttgaccctgatgatattatgccct

SEQ ID NO: 692751 - DNA, 25 bp, Rattus norvegicus
tttgacccttccagtctgatgccta

SEQ ID NO: 692752 - DNA, 25 bp, Rattus norvegicus
tttgacccttcctgtctgatgccta

SEQ ID NO: 692753 - DNA, 25 bp, Rattus norvegicus
tttgacccttctcacacgtgatcaa

SEQ ID NO: 692754 - DNA, 25 bp, Rattus norvegicus
tttgacccttctgacacgtgatcaa

SEQ ID NO: 692755 - DNA, 25 bp, Rattus norvegicus
tttgaccgtcacacatgtaccttgg

SEQ ID NO: 692756 - DNA, 25 bp, Rattus norvegicus
tttgaccgtcactcatgtaccttgg

SEQ ID NO: 692757 - DNA, 25 bp, Rattus norvegicus
tttgacctaccaatgacctcttcaa

SEQ ID NO: 692758 - DNA, 25 bp, Rattus norvegicus
tttgacctaccattgacctcttcaa

SEQ ID NO: 692759 - DNA, 25 bp, Rattus norvegicus
tttgacctatgcaggcctgaaacta

SEQ ID NO: 692760 - DNA, 25 bp, Rattus norvegicus
tttgacctatgctggcctgaaacta

SEQ ID NO: 692761 - DNA, 25 bp, Rattus norvegicus
tttgacctcatcacaggagctgctg

SEQ ID NO: 692762 - DNA, 25 bp, Rattus norvegicus
tttgacctcatctcaggagctgctg

SEQ ID NO: 692763 - DNA, 25 bp, Rattus norvegicus
tttgacctccaacttgtacactgat

SEQ ID NO: 692764 - DNA, 25 bp, Rattus norvegicus
tttgacctccaagttgtacactgat

SEQ ID NO: 692765 - DNA, 25 bp, Rattus norvegicus
tttgacctcttaagagccccaggat

SEQ ID NO: 692766 - DNA, 25 bp, Rattus norvegicus
tttgacctcttatgagccccaggat

SEQ ID NO: 692767 - DNA, 25 bp, Rattus norvegicus
tttgacctgaggaaaggagttgtct

SEQ ID NO: 692768 - DNA, 25 bp, Rattus norvegicus
tttgacctgaggtaaggagttgtct

SEQ ID NO: 692769 - DNA, 25 bp, Rattus norvegicus
tttgacctgatgatcggcgacacga

SEQ ID NO: 692770 - DNA, 25 bp, Rattus norvegicus
tttgacctgatgttcggcgacacga

SEQ ID NO: 692771 - DNA, 25 bp, Rattus norvegicus
tttgacctggagaagcatggcgctt

SEQ ID NO: 692772 - DNA, 25 bp, Rattus norvegicus
tttgacctggagtagcatggcgctt

SEQ ID NO: 692773 - DNA, 25 bp, Rattus norvegicus
tttgacctggatcccctcaatctat

SEQ ID NO: 692774 - DNA, 25 bp, Rattus norvegicus
tttgacctggatgccctcaatctat

SEQ ID NO: 692775 - DNA, 25 bp, Rattus norvegicus
tttgaccttgataccacaatgcctt

SEQ ID NO: 692776 - DNA, 25 bp, Rattus norvegicus
tttgaccttgattccacaatgcctt

SEQ ID NO: 692777 - DNA, 25 bp, Rattus norvegicus
tttgaccttggcattacctcattgc

SEQ ID NO: 692778 - DNA, 25 bp, Rattus norvegicus
tttgaccttggctttacctcattgc

SEQ ID NO: 692779 - DNA, 25 bp, Rattus norvegicus
tttgacctttcacagcagacctatg

SEQ ID NO: 692780 - DNA, 25 bp, Rattus norvegicus
tttgacctttcagagcagacctatg

SEQ ID NO: 692781 - DNA, 25 bp, Rattus norvegicus
tttgacggagggatctgatctcctc

SEQ ID NO: 692782 - DNA, 25 bp, Rattus norvegicus
tttgacggagggttctgatctcctc

SEQ ID NO: 692783 - DNA, 25 bp, Rattus norvegicus
tttgacgttggcagatatgcttcca

SEQ ID NO: 692784 - DNA, 25 bp, Rattus norvegicus
tttgacgttggctgatatgcttcca

SEQ ID NO: 692785 - DNA, 25 bp, Rattus norvegicus
tttgacgttgtccggagagcaccac

SEQ ID NO: 692786 - DNA, 25 bp, Rattus norvegicus
tttgacgttgtcgggagagcaccac

SEQ ID NO: 692787 - DNA, 25 bp, Rattus norvegicus
tttgacgttgtgacttgaagcctga

SEQ ID NO: 692788 - DNA, 25 bp, Rattus norvegicus
tttgacgttgtgatgttgtacccca

SEQ ID NO: 692789 - DNA, 25 bp, Rattus norvegicus
tttgacgttgtgtcttgaagcctga

SEQ ID NO: 692790 - DNA, 25 bp, Rattus norvegicus
tttgacgttgtgttgttgtacccca

SEQ ID NO: 692791 - DNA, 25 bp, Rattus norvegicus
tttgactaccatccattcctgattc

SEQ ID NO: 692792 - DNA, 25 bp, Rattus norvegicus
tttgactaccatgcattcctgattc

SEQ ID NO: 692793 - DNA, 25 bp, Rattus norvegicus
tttgactaccctctcctatgggcac

SEQ ID NO: 692794 - DNA, 25 bp, Rattus norvegicus
tttgactaccctgtcctatgggcac

SEQ ID NO: 692795 - DNA, 25 bp, Rattus norvegicus
tttgactatctcacccttgaaatac

SEQ ID NO: 692796 - DNA, 25 bp, Rattus norvegicus
tttgactatctctcccttgaaatac

SEQ ID NO: 692797 - DNA, 25 bp, Rattus norvegicus
tttgactatgtcactgccagaatca

SEQ ID NO: 692798 - DNA, 25 bp, Rattus norvegicus
tttgactatgtctctgccagaatca

SEQ ID NO: 692799 - DNA, 25 bp, Rattus norvegicus
tttgactcaattaccatagcactaa

SEQ ID NO: 692800 - DNA, 25 bp, Rattus norvegicus
tttgactcaatttccatagcactaa

SEQ ID NO: 692801 - DNA, 25 bp, Rattus norvegicus
tttgactcagtgaaaccgtgtggta

SEQ ID NO: 692802 - DNA, 25 bp, Rattus norvegicus
tttgactcagtgtaaccgtgtggta

SEQ ID NO: 692803 - DNA, 25 bp, Rattus norvegicus
tttgactgacctccccacgtatgaa

SEQ ID NO: 692804 - DNA, 25 bp, Rattus norvegicus
tttgactgacctgcccacgtatgaa

SEQ ID NO: 692805 - DNA, 25 bp, Rattus norvegicus
tttgactgagttcaggcttgtgaca

SEQ ID NO: 692806 - DNA, 25 bp, Rattus norvegicus
tttgactgagttgaggcttgtgaca

SEQ ID NO: 692807 - DNA, 25 bp, Rattus norvegicus
tttgactgcaagcttctaaacccct

SEQ ID NO: 692808 - DNA, 25 bp, Rattus norvegicus
tttgactgcaaggttctaaacccct

SEQ ID NO: 692809 - DNA, 25 bp, Rattus norvegicus
tttgactgccaccttgatgacattc

SEQ ID NO: 692810 - DNA, 25 bp, Rattus norvegicus
tttgactgccacgttgatgacattc

SEQ ID NO: 692811 - DNA, 25 bp, Rattus norvegicus
tttgactgtaatataacccctgcct

SEQ ID NO: 692812 - DNA, 25 bp, Rattus norvegicus
tttgactgtaatttaacccctgcct

SEQ ID NO: 692813 - DNA, 25 bp, Rattus norvegicus
tttgactgtgtcagaatctcccctt

SEQ ID NO: 692814 - DNA, 25 bp, Rattus norvegicus
tttgactgtgtctgaatctcccctt

SEQ ID NO: 692815 - DNA, 25 bp, Rattus norvegicus
tttgactgttaccatcccactgtcg

SEQ ID NO: 692816 - DNA, 25 bp, Rattus norvegicus
tttgactgttacgatcccactgtcg

SEQ ID NO: 692817 - DNA, 25 bp, Rattus norvegicus
tttgacttcatgatggtacactgta

SEQ ID NO: 692818 - DNA, 25 bp, Rattus norvegicus
tttgacttcatgcacacgctatctg

SEQ ID NO: 692819 - DNA, 25 bp, Rattus norvegicus
tttgacttcatggacacgctatctg

SEQ ID NO: 692820 - DNA, 25 bp, Rattus norvegicus
tttgacttcatgttggtacactgta

SEQ ID NO: 692821 - DNA, 25 bp, Rattus norvegicus
tttgacttccacagggattcatcaa

SEQ ID NO: 692822 - DNA, 25 bp, Rattus norvegicus
tttgacttccactgggattcatcaa

SEQ ID NO: 692823 - DNA, 25 bp, Rattus norvegicus
tttgacttcgtcaaactgatcgcca

SEQ ID NO: 692824 - DNA, 25 bp, Rattus norvegicus
tttgacttcgtctaactgatcgcca

SEQ ID NO: 692825 - DNA, 25 bp, Rattus norvegicus
tttgacttgactccccgagatgtgg

SEQ ID NO: 692826 - DNA, 25 bp, Rattus norvegicus
tttgacttgactgcccgagatgtgg

SEQ ID NO: 692827 - DNA, 25 bp, Rattus norvegicus
tttgacttgttcacatattcctgta

SEQ ID NO: 692828 - DNA, 25 bp, Rattus norvegicus
tttgacttgttctcatattcctgta

SEQ ID NO: 692829 - DNA, 25 bp, Rattus norvegicus
tttgacttgttgacatctcatgtac

SEQ ID NO: 692830 - DNA, 25 bp, Rattus norvegicus
tttgacttgttgtcatctcatgtac

SEQ ID NO: 692831 - DNA, 25 bp, Rattus norvegicus
tttgactttactaggtgggagggca

SEQ ID NO: 692832 - DNA, 25 bp, Rattus norvegicus
tttgactttacttggtgggagggca

SEQ ID NO: 692833 - DNA, 25 bp, Rattus norvegicus
tttgactttcatataccaactcctt

SEQ ID NO: 692834 - DNA, 25 bp, Rattus norvegicus
tttgactttcatttaccaactcctt

SEQ ID NO: 692835 - DNA, 25 bp, Rattus norvegicus
tttgagaaccacaggccctacctca

SEQ ID NO: 692836 - DNA, 25 bp, Rattus norvegicus
tttgagaaccactggccctacctca

SEQ ID NO: 692837 - DNA, 25 bp, Rattus norvegicus
tttgagaataccactgattttgttc

SEQ ID NO: 692838 - DNA, 25 bp, Rattus norvegicus
tttgagaatacctctgattttgttc

SEQ ID NO: 692839 - DNA, 25 bp, Rattus norvegicus
tttgagaatctcctgtccaagaaca

SEQ ID NO: 692840 - DNA, 25 bp, Rattus norvegicus
tttgagaatctcgtgtccaagaaca

SEQ ID NO: 692841 - DNA, 25 bp, Rattus norvegicus
tttgagaatttccttgacgcgcagc

SEQ ID NO: 692842 - DNA, 25 bp, Rattus norvegicus
tttgagaatttcgttgacgcgcagc

SEQ ID NO: 692843 - DNA, 25 bp, Rattus norvegicus
tttgagacatcacccaaggacccca

SEQ ID NO: 692844 - DNA, 25 bp, Rattus norvegicus
tttgagacatcagccaaggacccca

SEQ ID NO: 692845 - DNA, 25 bp, Rattus norvegicus
tttgagacccttaggcaaaggcctt

SEQ ID NO: 692846 - DNA, 25 bp, Rattus norvegicus
tttgagaccctttggcaaaggcctt

SEQ ID NO: 692847 - DNA, 25 bp, Rattus norvegicus
tttgagacgttaagagccctggccc

SEQ ID NO: 692848 - DNA, 25 bp, Rattus norvegicus
tttgagacgttatgagccctggccc

SEQ ID NO: 692849 - DNA, 25 bp, Rattus norvegicus
tttgagactgagaagcctccgccgt

SEQ ID NO: 692850 - DNA, 25 bp, Rattus norvegicus
tttgagactgagtagcctccgccgt

SEQ ID NO: 692851 - DNA, 25 bp, Rattus norvegicus
tttgagactttcagtcgtatccacc

SEQ ID NO: 692852 - DNA, 25 bp, Rattus norvegicus
tttgagactttctgtcgtatccacc

SEQ ID NO: 692853 - DNA, 25 bp, Rattus norvegicus
tttgagagccacattttcttccatc

SEQ ID NO: 692854 - DNA, 25 bp, Rattus norvegicus
tttgagagccactttttcttccatc

SEQ ID NO: 692855 - DNA, 25 bp, Rattus norvegicus
tttgagaggtatccgcgaccttgcc

SEQ ID NO: 692856 - DNA, 25 bp, Rattus norvegicus
tttgagaggtatgcgcgaccttgcc

SEQ ID NO: 692857 - DNA, 25 bp, Rattus norvegicus
tttgagagtcctactgttcttcagt

SEQ ID NO: 692858 - DNA, 25 bp, Rattus norvegicus
tttgagagtccttctgttcttcagt

SEQ ID NO: 692859 - DNA, 25 bp, Rattus norvegicus
tttgagagtgtacccagtgcccgat

SEQ ID NO: 692860 - DNA, 25 bp, Rattus norvegicus
tttgagagtgtagccagtgcccgat

SEQ ID NO: 692861 - DNA, 25 bp, Rattus norvegicus
tttgagatcagacctagtagactag

SEQ ID NO: 692862 - DNA, 25 bp, Rattus norvegicus
tttgagatcagagctagtagactag

SEQ ID NO: 692863 - DNA, 25 bp, Rattus norvegicus
tttgagatcatgagctccggcattt

SEQ ID NO: 692864 - DNA, 25 bp, Rattus norvegicus
tttgagatcatgtgctccggcattt

SEQ ID NO: 692865 - DNA, 25 bp, Rattus norvegicus
tttgagatccaaacgaaggtgcttt

SEQ ID NO: 692866 - DNA, 25 bp, Rattus norvegicus
tttgagatccaatcgaaggtgcttt

SEQ ID NO: 692867 - DNA, 25 bp, Rattus norvegicus
tttgagatccagagcccctaaagat

SEQ ID NO: 692868 - DNA, 25 bp, Rattus norvegicus
tttgagatccagtgcccctaaagat

SEQ ID NO: 692869 - DNA, 25 bp, Rattus norvegicus
tttgagatccataagcgagtcccct

SEQ ID NO: 692870 - DNA, 25 bp, Rattus norvegicus
tttgagatccattagcgagtcccct

SEQ ID NO: 692871 - DNA, 25 bp, Rattus norvegicus
tttgagatgacacagcagccggagc

SEQ ID NO: 692872 - DNA, 25 bp, Rattus norvegicus
tttgagatgacagagcagccggagc

SEQ ID NO: 692873 - DNA, 25 bp, Rattus norvegicus
tttgagatgagcactttgaaaccac

SEQ ID NO: 692874 - DNA, 25 bp, Rattus norvegicus
tttgagatgagctctttgaaaccac

SEQ ID NO: 692875 - DNA, 25 bp, Rattus norvegicus
tttgagatgctgctgtgccagaagc

SEQ ID NO: 692876 - DNA, 25 bp, Rattus norvegicus
tttgagatgctggtgtgccagaagc

SEQ ID NO: 692877 - DNA, 25 bp, Rattus norvegicus
tttgagattccccaaacacttcatc

SEQ ID NO: 692878 - DNA, 25 bp, Rattus norvegicus
tttgagattcccgaaacacttcatc

SEQ ID NO: 692879 - DNA, 25 bp, Rattus norvegicus
tttgagcaatctattgagttagcca

SEQ ID NO: 692880 - DNA, 25 bp, Rattus norvegicus
tttgagcaatcttttgagttagcca

SEQ ID NO: 692881 - DNA, 25 bp, Rattus norvegicus
tttgagcaatttcttgctctcgctg

SEQ ID NO: 692882 - DNA, 25 bp, Rattus norvegicus
tttgagcaatttgttgctctcgctg

SEQ ID NO: 692883 - DNA, 25 bp, Rattus norvegicus
tttgagcacagccttttccatgatc

SEQ ID NO: 692884 - DNA, 25 bp, Rattus norvegicus
tttgagcacagcgttttccatgatc

SEQ ID NO: 692885 - DNA, 25 bp, Rattus norvegicus
tttgagcacgagaaccgcagtggct

SEQ ID NO: 692886 - DNA, 25 bp, Rattus norvegicus
tttgagcacgagtaccgcagtggct

SEQ ID NO: 692887 - DNA, 25 bp, Rattus norvegicus
tttgagcactatacttccatcctgg

SEQ ID NO: 692888 - DNA, 25 bp, Rattus norvegicus
tttgagcactattcttccatcctgg

SEQ ID NO: 692889 - DNA, 25 bp, Rattus norvegicus
tttgagcagataattagcctattta

SEQ ID NO: 692890 - DNA, 25 bp, Rattus norvegicus
tttgagcagatatttagcctattta

SEQ ID NO: 692891 - DNA, 25 bp, Rattus norvegicus
tttgagcagctcagcctgggcatgg

SEQ ID NO: 692892 - DNA, 25 bp, Rattus norvegicus
tttgagcagctctgcctgggcatgg

SEQ ID NO: 692893 - DNA, 25 bp, Rattus norvegicus
tttgagcataaaagacccctttccc

SEQ ID NO: 692894 - DNA, 25 bp, Rattus norvegicus
tttgagcataaatgacccctttccc

SEQ ID NO: 692895 - DNA, 25 bp, Rattus norvegicus
tttgagccaagaagcctcatcctga

SEQ ID NO: 692896 - DNA, 25 bp, Rattus norvegicus
tttgagccaagatgcctcatcctga

SEQ ID NO: 692897 - DNA, 25 bp, Rattus norvegicus
tttgagccaaggaatctcctcagcc

SEQ ID NO: 692898 - DNA, 25 bp, Rattus norvegicus
tttgagccaaggtatctcctcagcc

SEQ ID NO: 692899 - DNA, 25 bp, Rattus norvegicus
tttgagccatacctgaagaccttga

SEQ ID NO: 692900 - DNA, 25 bp, Rattus norvegicus
tttgagccatacgtgaagaccttga

SEQ ID NO: 692901 - DNA, 25 bp, Rattus norvegicus
tttgagcccataagccaactcttct

SEQ ID NO: 692902 - DNA, 25 bp, Rattus norvegicus
tttgagcccatatgccaactcttct

SEQ ID NO: 692903 - DNA, 25 bp, Rattus norvegicus
tttgagccccaacgtagtttaggat

SEQ ID NO: 692904 - DNA, 25 bp, Rattus norvegicus
tttgagccccaaggtagtttaggat

SEQ ID NO: 692905 - DNA, 25 bp, Rattus norvegicus
tttgagccccagagtcaaggcagac

SEQ ID NO: 692906 - DNA, 25 bp, Rattus norvegicus
tttgagccccagctgtgaacgcaca

SEQ ID NO: 692907 - DNA, 25 bp, Rattus norvegicus
tttgagccccaggtgtgaacgcaca

SEQ ID NO: 692908 - DNA, 25 bp, Rattus norvegicus
tttgagccccagtgtcaaggcagac

SEQ ID NO: 692909 - DNA, 25 bp, Rattus norvegicus
tttgagccctggagccatgaatccc

SEQ ID NO: 692910 - DNA, 25 bp, Rattus norvegicus
tttgagccctggtgccatgaatccc

SEQ ID NO: 692911 - DNA, 25 bp, Rattus norvegicus
tttgagccgcctagcaggccatctt

SEQ ID NO: 692912 - DNA, 25 bp, Rattus norvegicus
tttgagccgccttgcaggccatctt

SEQ ID NO: 692913 - DNA, 25 bp, Rattus norvegicus
tttgagctatataacctactcctag

SEQ ID NO: 692914 - DNA, 25 bp, Rattus norvegicus
tttgagctatattacctactcctag

SEQ ID NO: 692915 - DNA, 25 bp, Rattus norvegicus
tttgagctcacccatagagcctgtg

SEQ ID NO: 692916 - DNA, 25 bp, Rattus norvegicus
tttgagctcaccgatagagcctgtg

SEQ ID NO: 692917 - DNA, 25 bp, Rattus norvegicus
tttgagctctcacatgcccaggctt

SEQ ID NO: 692918 - DNA, 25 bp, Rattus norvegicus
tttgagctctcagatgcccaggctt

SEQ ID NO: 692919 - DNA, 25 bp, Rattus norvegicus
tttgagctctctcggtcatcctgga

SEQ ID NO: 692920 - DNA, 25 bp, Rattus norvegicus
tttgagctctctgggtcatcctgga

SEQ ID NO: 692921 - DNA, 25 bp, Rattus norvegicus
tttgagctctgaataatggcatcat

SEQ ID NO: 692922 - DNA, 25 bp, Rattus norvegicus
tttgagctctgattaatggcatcat

SEQ ID NO: 692923 - DNA, 25 bp, Rattus norvegicus
tttgagctgtttcttcagctccaga

SEQ ID NO: 692924 - DNA, 25 bp, Rattus norvegicus
tttgagctgtttgttcagctccaga

SEQ ID NO: 692925 - DNA, 25 bp, Rattus norvegicus
tttgagcttggacttcccacccgac

SEQ ID NO: 692926 - DNA, 25 bp, Rattus norvegicus
tttgagcttggagttcccacccgac

SEQ ID NO: 692927 - DNA, 25 bp, Rattus norvegicus
tttgagctttaaatgtatgttacag

SEQ ID NO: 692928 - DNA, 25 bp, Rattus norvegicus
tttgagctttaattgtatgttacag

SEQ ID NO: 692929 - DNA, 25 bp, Rattus norvegicus
tttgaggacacgacagatcctgaga

SEQ ID NO: 692930 - DNA, 25 bp, Rattus norvegicus
tttgaggacacgtcagatcctgaga

SEQ ID NO: 692931 - DNA, 25 bp, Rattus norvegicus
tttgaggactcgcagctttgtggat

SEQ ID NO: 692932 - DNA, 25 bp, Rattus norvegicus
tttgaggactcgctgagctgccgaa

SEQ ID NO: 692933 - DNA, 25 bp, Rattus norvegicus
tttgaggactcggagctttgtggat

SEQ ID NO: 692934 - DNA, 25 bp, Rattus norvegicus
tttgaggactcggtgagctgccgaa

SEQ ID NO: 692935 - DNA, 25 bp, Rattus norvegicus
tttgaggaggtgacctagtgcccct

SEQ ID NO: 692936 - DNA, 25 bp, Rattus norvegicus
tttgaggaggtgtcctagtgcccct

SEQ ID NO: 692937 - DNA, 25 bp, Rattus norvegicus
tttgaggccactcaaacacatttat

SEQ ID NO: 692938 - DNA, 25 bp, Rattus norvegicus
tttgaggccactgaaacacatttat

SEQ ID NO: 692939 - DNA, 25 bp, Rattus norvegicus
tttgaggccaggattctctatgcag

SEQ ID NO: 692940 - DNA, 25 bp, Rattus norvegicus
tttgaggccaggtttctctatgcag

SEQ ID NO: 692941 - DNA, 25 bp, Rattus norvegicus
tttgaggccagtctcgtatacagac

SEQ ID NO: 692942 - DNA, 25 bp, Rattus norvegicus
tttgaggccagtgtcgtatacagac

SEQ ID NO: 692943 - DNA, 25 bp, Rattus norvegicus
tttgaggccatcaaggcagcagcca

SEQ ID NO: 692944 - DNA, 25 bp, Rattus norvegicus
tttgaggccatctaggcagcagcca

SEQ ID NO: 692945 - DNA, 25 bp, Rattus norvegicus
tttgaggccgacaatggacggtcct

SEQ ID NO: 692946 - DNA, 25 bp, Rattus norvegicus
tttgaggccgactatggacggtcct

SEQ ID NO: 692947 - DNA, 25 bp, Rattus norvegicus
tttgaggctatcctgagctatgtaa

SEQ ID NO: 692948 - DNA, 25 bp, Rattus norvegicus
tttgaggctatcgtgagctatgtaa

SEQ ID NO: 692949 - DNA, 25 bp, Rattus norvegicus
tttgaggctcacatatgctacacag

SEQ ID NO: 692950 - DNA, 25 bp, Rattus norvegicus
tttgaggctcacttatgctacacag

SEQ ID NO: 692951 - DNA, 25 bp, Rattus norvegicus
tttgaggctcccattgcaataacaa

SEQ ID NO: 692952 - DNA, 25 bp, Rattus norvegicus
tttgaggctccctttgcaataacaa

SEQ ID NO: 692953 - DNA, 25 bp, Rattus norvegicus
tttgagggccctaagctggcatcaa

SEQ ID NO: 692954 - DNA, 25 bp, Rattus norvegicus
tttgagggcccttagctggcatcaa

SEQ ID NO: 692955 - DNA, 25 bp, Rattus norvegicus
tttgagggcgcccaggacaacttac

SEQ ID NO: 692956 - DNA, 25 bp, Rattus norvegicus
tttgagggcgccgaggacaacttac

SEQ ID NO: 692957 - DNA, 25 bp, Rattus norvegicus
tttgaggtaaccagatccagcagtt

SEQ ID NO: 692958 - DNA, 25 bp, Rattus norvegicus
tttgaggtaacctgatccagcagtt

SEQ ID NO: 692959 - DNA, 25 bp, Rattus norvegicus
tttgaggtagtgattcctgttcaat

SEQ ID NO: 692960 - DNA, 25 bp, Rattus norvegicus
tttgaggtagtgtttcctgttcaat

SEQ ID NO: 692961 - DNA, 25 bp, Rattus norvegicus
tttgaggtattgactttgagaacac

SEQ ID NO: 692962 - DNA, 25 bp, Rattus norvegicus
tttgaggtattgtctttgagaacac

SEQ ID NO: 692963 - DNA, 25 bp, Rattus norvegicus
tttgaggtcaccaaaggcctttgat

SEQ ID NO: 692964 - DNA, 25 bp, Rattus norvegicus
tttgaggtcacctaaggcctttgat

SEQ ID NO: 692965 - DNA, 25 bp, Rattus norvegicus
tttgaggtcagcacggaatccatac

SEQ ID NO: 692966 - DNA, 25 bp, Rattus norvegicus
tttgaggtcagcctgatccacattg

SEQ ID NO: 692967 - DNA, 25 bp, Rattus norvegicus
tttgaggtcagcgtgatccacattg

SEQ ID NO: 692968 - DNA, 25 bp, Rattus norvegicus
tttgaggtcagctcggaatccatac

SEQ ID NO: 692969 - DNA, 25 bp, Rattus norvegicus
tttgaggtccagcaggtttccccag

SEQ ID NO: 692970 - DNA, 25 bp, Rattus norvegicus
tttgaggtccaggaggtttccccag

SEQ ID NO: 692971 - DNA, 25 bp, Rattus norvegicus
tttgaggtcgccctgactgcctaac

SEQ ID NO: 692972 - DNA, 25 bp, Rattus norvegicus
tttgaggtcgccgtgactgcctaac

SEQ ID NO: 692973 - DNA, 25 bp, Rattus norvegicus
tttgaggtttccctgctagcacact

SEQ ID NO: 692974 - DNA, 25 bp, Rattus norvegicus
tttgaggtttccgtgctagcacact

SEQ ID NO: 692975 - DNA, 25 bp, Rattus norvegicus
tttgagtaacagaaacctctccccg

SEQ ID NO: 692976 - DNA, 25 bp, Rattus norvegicus
tttgagtaacagtaacctctccccg

SEQ ID NO: 692977 - DNA, 25 bp, Rattus norvegicus
tttgagtagaccaactgcagctgcc

SEQ ID NO: 692978 - DNA, 25 bp, Rattus norvegicus
tttgagtagacctactgcagctgcc

SEQ ID NO: 692979 - DNA, 25 bp, Rattus norvegicus
tttgagtaggctagctgtccagtga

SEQ ID NO: 692980 - DNA, 25 bp, Rattus norvegicus
tttgagtaggcttgctgtccagtga

SEQ ID NO: 692981 - DNA, 25 bp, Rattus norvegicus
tttgagtagtccactggctttgctt

SEQ ID NO: 692982 - DNA, 25 bp, Rattus norvegicus
tttgagtagtcctctggctttgctt

SEQ ID NO: 692983 - DNA, 25 bp, Rattus norvegicus
tttgagtcagtgacttacatgttaa

SEQ ID NO: 692984 - DNA, 25 bp, Rattus norvegicus
tttgagtcagtgtcttacatgttaa

SEQ ID NO: 692985 - DNA, 25 bp, Rattus norvegicus
tttgagtccatgaagtgggcgcgca

SEQ ID NO: 692986 - DNA, 25 bp, Rattus norvegicus
tttgagtccatgtagtgggcgcgca

SEQ ID NO: 692987 - DNA, 25 bp, Rattus norvegicus
tttgagtccccaacgctctcataga

SEQ ID NO: 692988 - DNA, 25 bp, Rattus norvegicus
tttgagtccccatcgctctcataga

SEQ ID NO: 692989 - DNA, 25 bp, Rattus norvegicus
tttgagtccctccttcctgggtgag

SEQ ID NO: 692990 - DNA, 25 bp, Rattus norvegicus
tttgagtccctcgttcctgggtgag

SEQ ID NO: 692991 - DNA, 25 bp, Rattus norvegicus
tttgagtctatcattccggtgggca

SEQ ID NO: 692992 - DNA, 25 bp, Rattus norvegicus
tttgagtctatctttccggtgggca

SEQ ID NO: 692993 - DNA, 25 bp, Rattus norvegicus
tttgagtctgagacctaactgccta

SEQ ID NO: 692994 - DNA, 25 bp, Rattus norvegicus
tttgagtctgagtcctaactgccta

SEQ ID NO: 692995 - DNA, 25 bp, Rattus norvegicus
tttgagtgacgacgttctcacacca

SEQ ID NO: 692996 - DNA, 25 bp, Rattus norvegicus
tttgagtgacgaggttctcacacca

SEQ ID NO: 692997 - DNA, 25 bp, Rattus norvegicus
tttgagtgtaggaaaatgtgcgaca

SEQ ID NO: 692998 - DNA, 25 bp, Rattus norvegicus
tttgagtgtaggtaaatgtgcgaca

SEQ ID NO: 692999 - DNA, 25 bp, Rattus norvegicus
tttgagttaaagatcccagagggta

SEQ ID NO: 693000 - DNA, 25 bp, Rattus norvegicus
tttgagttaaagttcccagagggta

SEQ ID NO: 693001 - DNA, 25 bp, Rattus norvegicus
tttgagttaccacttagttccctgg

SEQ ID NO: 693002 - DNA, 25 bp, Rattus norvegicus
tttgagttaccagttagttccctgg

SEQ ID NO: 693003 - DNA, 25 bp, Rattus norvegicus
tttgagttcacgatggatccttgta

SEQ ID NO: 693004 - DNA, 25 bp, Rattus norvegicus
tttgagttcacgttggatccttgta

SEQ ID NO: 693005 - DNA, 25 bp, Rattus norvegicus
tttgataacccactagacctttcca

SEQ ID NO: 693006 - DNA, 25 bp, Rattus norvegicus
tttgataacccagtagacctttcca

SEQ ID NO: 693007 - DNA, 25 bp, Rattus norvegicus
tttgatacccacctggtctacagag

SEQ ID NO: 693008 - DNA, 25 bp, Rattus norvegicus
tttgatacccacgtggtctacagag

SEQ ID NO: 693009 - DNA, 25 bp, Rattus norvegicus
tttgatacccctaactgcagagtgg

SEQ ID NO: 693010 - DNA, 25 bp, Rattus norvegicus
tttgataccccttactgcagagtgg

SEQ ID NO: 693011 - DNA, 25 bp, Rattus norvegicus
tttgatatccacatatgccacgggc

SEQ ID NO: 693012 - DNA, 25 bp, Rattus norvegicus
tttgatatccacttatgccacgggc

SEQ ID NO: 693013 - DNA, 25 bp, Rattus norvegicus
tttgatatgactctacgtctgtggg

SEQ ID NO: 693014 - DNA, 25 bp, Rattus norvegicus
tttgatatgactgtacgtctgtggg

SEQ ID NO: 693015 - DNA, 25 bp, Rattus norvegicus
tttgatatggaccactgggtgcagt

SEQ ID NO: 693016 - DNA, 25 bp, Rattus norvegicus
tttgatatggacgactgggtgcagt

SEQ ID NO: 693017 - DNA, 25 bp, Rattus norvegicus
tttgatcacataagccagccatggc

SEQ ID NO: 693018 - DNA, 25 bp, Rattus norvegicus
tttgatcacatatgccagccatggc

SEQ ID NO: 693019 - DNA, 25 bp, Rattus norvegicus
tttgatcacctgagtgcgcgcctga

SEQ ID NO: 693020 - DNA, 25 bp, Rattus norvegicus
tttgatcacctgtgtgcgcgcctga

SEQ ID NO: 693021 - DNA, 25 bp, Rattus norvegicus
tttgatcagatgaaccctgttgccc

SEQ ID NO: 693022 - DNA, 25 bp, Rattus norvegicus
tttgatcagatgtaccctgttgccc

SEQ ID NO: 693023 - DNA, 25 bp, Rattus norvegicus
tttgatcagtgccttttgaggtcca

SEQ ID NO: 693024 - DNA, 25 bp, Rattus norvegicus
tttgatcagtgcgttttgaggtcca

SEQ ID NO: 693025 - DNA, 25 bp, Rattus norvegicus
tttgatcatcttcatccaccctggg

SEQ ID NO: 693026 - DNA, 25 bp, Rattus norvegicus
tttgatcatcttgatccaccctggg

SEQ ID NO: 693027 - DNA, 25 bp, Rattus norvegicus
tttgatcatggccttccttaggtag

SEQ ID NO: 693028 - DNA, 25 bp, Rattus norvegicus
tttgatcatggcgttccttaggtag

SEQ ID NO: 693029 - DNA, 25 bp, Rattus norvegicus
tttgatcatgtaaaaccgtttggcg

SEQ ID NO: 693030 - DNA, 25 bp, Rattus norvegicus
tttgatcatgtataaccgtttggcg

SEQ ID NO: 693031 - DNA, 25 bp, Rattus norvegicus
tttgatccaaatattccaggccctt

SEQ ID NO: 693032 - DNA, 25 bp, Rattus norvegicus
tttgatccaaattttccaggccctt

SEQ ID NO: 693033 - DNA, 25 bp, Rattus norvegicus
tttgatccaaccaactatacgctcc

SEQ ID NO: 693034 - DNA, 25 bp, Rattus norvegicus
tttgatccaacctactatacgctcc

SEQ ID NO: 693035 - DNA, 25 bp, Rattus norvegicus
tttgatccacacagtgcccaggaca

SEQ ID NO: 693036 - DNA, 25 bp, Rattus norvegicus
tttgatccacactgtgcccaggaca

SEQ ID NO: 693037 - DNA, 25 bp, Rattus norvegicus
tttgatccagagacttttgccttta

SEQ ID NO: 693038 - DNA, 25 bp, Rattus norvegicus
tttgatccagagtcttttgccttta

SEQ ID NO: 693039 - DNA, 25 bp, Rattus norvegicus
tttgatccattacccacatttcagg

SEQ ID NO: 693040 - DNA, 25 bp, Rattus norvegicus
tttgatccattagccacatttcagg

SEQ ID NO: 693041 - DNA, 25 bp, Rattus norvegicus
tttgatcccgccatcctgctggatt

SEQ ID NO: 693042 - DNA, 25 bp, Rattus norvegicus
tttgatcccgccttcctgctggatt

SEQ ID NO: 693043 - DNA, 25 bp, Rattus norvegicus
tttgatcccggtactggcgaggcag

SEQ ID NO: 693044 - DNA, 25 bp, Rattus norvegicus
tttgatcccggttctggcgaggcag

SEQ ID NO: 693045 - DNA, 25 bp, Rattus norvegicus
tttgatccctttattgcacttgtta

SEQ ID NO: 693046 - DNA, 25 bp, Rattus norvegicus
tttgatcccttttttgcacttgtta

SEQ ID NO: 693047 - DNA, 25 bp, Rattus norvegicus
tttgatcctgacaacaagcgggtga

SEQ ID NO: 693048 - DNA, 25 bp, Rattus norvegicus
tttgatcctgactacaagcgggtga

SEQ ID NO: 693049 - DNA, 25 bp, Rattus norvegicus
tttgatctaggacttgcactgccgt

SEQ ID NO: 693050 - DNA, 25 bp, Rattus norvegicus
tttgatctaggagttgcactgccgt

SEQ ID NO: 693051 - DNA, 25 bp, Rattus norvegicus
tttgatctcaataatgttccactgg

SEQ ID NO: 693052 - DNA, 25 bp, Rattus norvegicus
tttgatctcaattatgttccactgg

SEQ ID NO: 693053 - DNA, 25 bp, Rattus norvegicus
tttgatctcatacggccactgatac

SEQ ID NO: 693054 - DNA, 25 bp, Rattus norvegicus
tttgatctcatagggccactgatac

SEQ ID NO: 693055 - DNA, 25 bp, Rattus norvegicus
tttgatctcctcattggacatctct

SEQ ID NO: 693056 - DNA, 25 bp, Rattus norvegicus
tttgatctcctctttggacatctct

SEQ ID NO: 693057 - DNA, 25 bp, Rattus norvegicus
tttgatctggataacacgctctggc

SEQ ID NO: 693058 - DNA, 25 bp, Rattus norvegicus
tttgatctggattacacgctctggc

SEQ ID NO: 693059 - DNA, 25 bp, Rattus norvegicus
tttgatctgtgtctgccagtgtgtg

SEQ ID NO: 693060 - DNA, 25 bp, Rattus norvegicus
tttgatctgtgtgtgccagtgtgtg

SEQ ID NO: 693061 - DNA, 25 bp, Rattus norvegicus
tttgatcttcgcacagcattatgtc

SEQ ID NO: 693062 - DNA, 25 bp, Rattus norvegicus
tttgatcttcgctcagcattatgtc

SEQ ID NO: 693063 - DNA, 25 bp, Rattus norvegicus
tttgatcttgatccctagcgagtct

SEQ ID NO: 693064 - DNA, 25 bp, Rattus norvegicus
tttgatcttgatgcctagcgagtct

SEQ ID NO: 693065 - DNA, 25 bp, Rattus norvegicus
tttgatcttggccactcatggaagc

SEQ ID NO: 693066 - DNA, 25 bp, Rattus norvegicus
tttgatcttggcgactcatggaagc

SEQ ID NO: 693067 - DNA, 25 bp, Rattus norvegicus
tttgatgaagccatcctcaccattt

SEQ ID NO: 693068 - DNA, 25 bp, Rattus norvegicus
tttgatgaagccttcctcaccattt

SEQ ID NO: 693069 - DNA, 25 bp, Rattus norvegicus
tttgatgaatttacctcccactgct

SEQ ID NO: 693070 - DNA, 25 bp, Rattus norvegicus
tttgatgaattttcctcccactgct

SEQ ID NO: 693071 - DNA, 25 bp, Rattus norvegicus
tttgatgactataagtgtttcctgt

SEQ ID NO: 693072 - DNA, 25 bp, Rattus norvegicus
tttgatgactattagtgtttcctgt

SEQ ID NO: 693073 - DNA, 25 bp, Rattus norvegicus
tttgatgactccattacagggccac

SEQ ID NO: 693074 - DNA, 25 bp, Rattus norvegicus
tttgatgactcctttacagggccac

SEQ ID NO: 693075 - DNA, 25 bp, Rattus norvegicus
tttgatgagctcaggaactcctgcc

SEQ ID NO: 693076 - DNA, 25 bp, Rattus norvegicus
tttgatgagctctggaactcctgcc

SEQ ID NO: 693077 - DNA, 25 bp, Rattus norvegicus
tttgatgcattcacttcggtcttag

SEQ ID NO: 693078 - DNA, 25 bp, Rattus norvegicus
tttgatgcattctcttcggtcttag

SEQ ID NO: 693079 - DNA, 25 bp, Rattus norvegicus
tttgatgccatcacgggttgaaatc

SEQ ID NO: 693080 - DNA, 25 bp, Rattus norvegicus
tttgatgccatctcgggttgaaatc

SEQ ID NO: 693081 - DNA, 25 bp, Rattus norvegicus
tttgatgcccaaccctagactcgtc

SEQ ID NO: 693082 - DNA, 25 bp, Rattus norvegicus
tttgatgcccaagcctagactcgtc

SEQ ID NO: 693083 - DNA, 25 bp, Rattus norvegicus
tttgatgcccctactgggactaata

SEQ ID NO: 693084 - DNA, 25 bp, Rattus norvegicus
tttgatgccccttctgggactaata

SEQ ID NO: 693085 - DNA, 25 bp, Rattus norvegicus
tttgatgcctggaacctacatggtg

SEQ ID NO: 693086 - DNA, 25 bp, Rattus norvegicus
tttgatgcctggtacctacatggtg

SEQ ID NO: 693087 - DNA, 25 bp, Rattus norvegicus
tttgatgctgaaacagggccctgct

SEQ ID NO: 693088 - DNA, 25 bp, Rattus norvegicus
tttgatgctgaatcagggccctgct

SEQ ID NO: 693089 - DNA, 25 bp, Rattus norvegicus
tttgatgctgccctatcaggtgaga

SEQ ID NO: 693090 - DNA, 25 bp, Rattus norvegicus
tttgatgctgccgtatcaggtgaga

SEQ ID NO: 693091 - DNA, 25 bp, Rattus norvegicus
tttgatggagaacgttgctcgcccc

SEQ ID NO: 693092 - DNA, 25 bp, Rattus norvegicus
tttgatggagaaggttgctcgcccc

SEQ ID NO: 693093 - DNA, 25 bp, Rattus norvegicus
tttgatggagatcgcgcaccgcgac

SEQ ID NO: 693094 - DNA, 25 bp, Rattus norvegicus
tttgatggagatggcgcaccgcgac

SEQ ID NO: 693095 - DNA, 25 bp, Rattus norvegicus
tttgatggcagtcgcctctcagaaa

SEQ ID NO: 693096 - DNA, 25 bp, Rattus norvegicus
tttgatggcagtggcctctcagaaa

SEQ ID NO: 693097 - DNA, 25 bp, Rattus norvegicus
tttgatggcccaatgcagttctctg

SEQ ID NO: 693098 - DNA, 25 bp, Rattus norvegicus
tttgatggcccattgcagttctctg

SEQ ID NO: 693099 - DNA, 25 bp, Rattus norvegicus
tttgatgggcagacacacgctcaag

SEQ ID NO: 693100 - DNA, 25 bp, Rattus norvegicus
tttgatgggcagtcacacgctcaag

SEQ ID NO: 693101 - DNA, 25 bp, Rattus norvegicus
tttgatgtagcaactttgagctggg

SEQ ID NO: 693102 - DNA, 25 bp, Rattus norvegicus
tttgatgtagcatctttgagctggg

SEQ ID NO: 693103 - DNA, 25 bp, Rattus norvegicus
tttgatgtgggaccaagcccactat

SEQ ID NO: 693104 - DNA, 25 bp, Rattus norvegicus
tttgatgtgggagcaagcccactat

SEQ ID NO: 693105 - DNA, 25 bp, Rattus norvegicus
tttgatgtggtgctgacagacccct

SEQ ID NO: 693106 - DNA, 25 bp, Rattus norvegicus
tttgatgtggtggtgacagacccct

SEQ ID NO: 693107 - DNA, 25 bp, Rattus norvegicus
tttgatgtgtccatcagagtccagc

SEQ ID NO: 693108 - DNA, 25 bp, Rattus norvegicus
tttgatgtgtccttcagagtccagc

SEQ ID NO: 693109 - DNA, 25 bp, Rattus norvegicus
tttgattaaatcctatcccactcca

SEQ ID NO: 693110 - DNA, 25 bp, Rattus norvegicus
tttgattaaatcgtatcccactcca

SEQ ID NO: 693111 - DNA, 25 bp, Rattus norvegicus
tttgattaagtgacctcggctcgtt

SEQ ID NO: 693112 - DNA, 25 bp, Rattus norvegicus
tttgattaagtgtcctcggctcgtt

SEQ ID NO: 693113 - DNA, 25 bp, Rattus norvegicus
tttgattaccttcccaacacctgtg

SEQ ID NO: 693114 - DNA, 25 bp, Rattus norvegicus
tttgattaccttgccaacacctgtg

SEQ ID NO: 693115 - DNA, 25 bp, Rattus norvegicus
tttgattatgacaacacccgctcac

SEQ ID NO: 693116 - DNA, 25 bp, Rattus norvegicus
tttgattatgactacacccgctcac

SEQ ID NO: 693117 - DNA, 25 bp, Rattus norvegicus
tttgattcaatcagtcttccccaag

SEQ ID NO: 693118 - DNA, 25 bp, Rattus norvegicus
tttgattcaatctgtcttccccaag

SEQ ID NO: 693119 - DNA, 25 bp, Rattus norvegicus
tttgattcacttccagcatgtccta

SEQ ID NO: 693120 - DNA, 25 bp, Rattus norvegicus
tttgattcacttgcagcatgtccta

SEQ ID NO: 693121 - DNA, 25 bp, Rattus norvegicus
tttgattcagttattcctaaagaag

SEQ ID NO: 693122 - DNA, 25 bp, Rattus norvegicus
tttgattcagtttttcctaaagaag

SEQ ID NO: 693123 - DNA, 25 bp, Rattus norvegicus
tttgattcccagcagcccgtggaga

SEQ ID NO: 693124 - DNA, 25 bp, Rattus norvegicus
tttgattcccaggagcccgtggaga

SEQ ID NO: 693125 - DNA, 25 bp, Rattus norvegicus
tttgattccgagctgacagtgtctt

SEQ ID NO: 693126 - DNA, 25 bp, Rattus norvegicus
tttgattccgaggtgacagtgtctt

SEQ ID NO: 693127 - DNA, 25 bp, Rattus norvegicus
tttgattcctgtactgtgttcctga

SEQ ID NO: 693128 - DNA, 25 bp, Rattus norvegicus
tttgattcctgttctgtgttcctga

SEQ ID NO: 693129 - DNA, 25 bp, Rattus norvegicus
tttgattcctttagttagccctgtc

SEQ ID NO: 693130 - DNA, 25 bp, Rattus norvegicus
tttgattccttttgttagccctgtc

SEQ ID NO: 693131 - DNA, 25 bp, Rattus norvegicus
tttgattcgttgaactcactctcca

SEQ ID NO: 693132 - DNA, 25 bp, Rattus norvegicus
tttgattcgttgtactcactctcca

SEQ ID NO: 693133 - DNA, 25 bp, Rattus norvegicus
tttgattctaccactactgctctca

SEQ ID NO: 693134 - DNA, 25 bp, Rattus norvegicus
tttgattctacctctactgctctca

SEQ ID NO: 693135 - DNA, 25 bp, Rattus norvegicus
tttgattctactcggaggctgactc

SEQ ID NO: 693136 - DNA, 25 bp, Rattus norvegicus
tttgattctactgggaggctgactc

SEQ ID NO: 693137 - DNA, 25 bp, Rattus norvegicus
tttgattgacctactatgcttatgt

SEQ ID NO: 693138 - DNA, 25 bp, Rattus norvegicus
tttgattgaccttctatgcttatgt

SEQ ID NO: 693139 - DNA, 25 bp, Rattus norvegicus
tttgattgatacacgacagcctcct

SEQ ID NO: 693140 - DNA, 25 bp, Rattus norvegicus
tttgattgatactcgacagcctcct

SEQ ID NO: 693141 - DNA, 25 bp, Rattus norvegicus
tttgattgccctctgtgtgaagaag

SEQ ID NO: 693142 - DNA, 25 bp, Rattus norvegicus
tttgattgccctgtgtgtgaagaag

SEQ ID NO: 693143 - DNA, 25 bp, Rattus norvegicus
tttgattgctttcattctctggctc

SEQ ID NO: 693144 - DNA, 25 bp, Rattus norvegicus
tttgattgctttgattctctggctc

SEQ ID NO: 693145 - DNA, 25 bp, Rattus norvegicus
tttgattgtccacggtgaagctgtg

SEQ ID NO: 693146 - DNA, 25 bp, Rattus norvegicus
tttgattgtccagggtgaagctgtg

SEQ ID NO: 693147 - DNA, 25 bp, Rattus norvegicus
tttgattgtgctctcatgtctccta

SEQ ID NO: 693148 - DNA, 25 bp, Rattus norvegicus
tttgattgtgctgtcatgtctccta

SEQ ID NO: 693149 - DNA, 25 bp, Rattus norvegicus
tttgattgttcccatgagactccat

SEQ ID NO: 693150 - DNA, 25 bp, Rattus norvegicus
tttgattgttccgatgagactccat

SEQ ID NO: 693151 - DNA, 25 bp, Rattus norvegicus
tttgattgttctacagcttcatctg

SEQ ID NO: 693152 - DNA, 25 bp, Rattus norvegicus
tttgattgttcttcagcttcatctg

SEQ ID NO: 693153 - DNA, 25 bp, Rattus norvegicus
tttgatttatgccttgtatctaccc

SEQ ID NO: 693154 - DNA, 25 bp, Rattus norvegicus
tttgatttatgcgttgtatctaccc

SEQ ID NO: 693155 - DNA, 25 bp, Rattus norvegicus
tttgatttcagcatatgccctggct

SEQ ID NO: 693156 - DNA, 25 bp, Rattus norvegicus
tttgatttcagcttatgccctggct

SEQ ID NO: 693157 - DNA, 25 bp, Rattus norvegicus
tttgatttcccaaaagttccaccct

SEQ ID NO: 693158 - DNA, 25 bp, Rattus norvegicus
tttgatttcccataagttccaccct

SEQ ID NO: 693159 - DNA, 25 bp, Rattus norvegicus
tttgatttctacaggcacccatgtg

SEQ ID NO: 693160 - DNA, 25 bp, Rattus norvegicus
tttgatttctacatcccacaggttc

SEQ ID NO: 693161 - DNA, 25 bp, Rattus norvegicus
tttgatttctactggcacccatgtg

SEQ ID NO: 693162 - DNA, 25 bp, Rattus norvegicus
tttgatttctacttcccacaggttc

SEQ ID NO: 693163 - DNA, 25 bp, Rattus norvegicus
tttgatttcttcataggcctgttta

SEQ ID NO: 693164 - DNA, 25 bp, Rattus norvegicus
tttgatttcttcttaggcctgttta

SEQ ID NO: 693165 - DNA, 25 bp, Rattus norvegicus
tttgattttgtgatgctctttatcc

SEQ ID NO: 693166 - DNA, 25 bp, Rattus norvegicus
tttgattttgtgttgctctttatcc

SEQ ID NO: 693167 - DNA, 25 bp, Rattus norvegicus
tttgcaaaaactctggcccttcatc

SEQ ID NO: 693168 - DNA, 25 bp, Rattus norvegicus
tttgcaaaaactgtggcccttcatc

SEQ ID NO: 693169 - DNA, 25 bp, Rattus norvegicus
tttgcaaaccagagttccactgcgc

SEQ ID NO: 693170 - DNA, 25 bp, Rattus norvegicus
tttgcaaaccagtgttccactgcgc

SEQ ID NO: 693171 - DNA, 25 bp, Rattus norvegicus
tttgcaaaggtcacctcagggaggt

SEQ ID NO: 693172 - DNA, 25 bp, Rattus norvegicus
tttgcaaaggtctcctcagggaggt

SEQ ID NO: 693173 - DNA, 25 bp, Rattus norvegicus
tttgcaaatacaagtaatcgacgag

SEQ ID NO: 693174 - DNA, 25 bp, Rattus norvegicus
tttgcaaatacatgtaatcgacgag

SEQ ID NO: 693175 - DNA, 25 bp, Rattus norvegicus
tttgcaaatgctataatggccgaca

SEQ ID NO: 693176 - DNA, 25 bp, Rattus norvegicus
tttgcaaatgctttaatggccgaca

SEQ ID NO: 693177 - DNA, 25 bp, Rattus norvegicus
tttgcaaattccatttcactctgcc

SEQ ID NO: 693178 - DNA, 25 bp, Rattus norvegicus
tttgcaaattccttttcactctgcc

SEQ ID NO: 693179 - DNA, 25 bp, Rattus norvegicus
tttgcaacagctaccacttacttta

SEQ ID NO: 693180 - DNA, 25 bp, Rattus norvegicus
tttgcaacagcttccacttacttta

SEQ ID NO: 693181 - DNA, 25 bp, Rattus norvegicus
tttgcaaccattctgtgctactcat

SEQ ID NO: 693182 - DNA, 25 bp, Rattus norvegicus
tttgcaaccattgtgtgctactcat

SEQ ID NO: 693183 - DNA, 25 bp, Rattus norvegicus
tttgcaacccctaagcttcaaacgt

SEQ ID NO: 693184 - DNA, 25 bp, Rattus norvegicus
tttgcaaccccttagcttcaaacgt

SEQ ID NO: 693185 - DNA, 25 bp, Rattus norvegicus
tttgcaactcaacattctgaaatgg

SEQ ID NO: 693186 - DNA, 25 bp, Rattus norvegicus
tttgcaactcaagattctgaaatgg

SEQ ID NO: 693187 - DNA, 25 bp, Rattus norvegicus
tttgcaacttttagtgacattttcc

SEQ ID NO: 693188 - DNA, 25 bp, Rattus norvegicus
tttgcaactttttgtgacattttcc

SEQ ID NO: 693189 - DNA, 25 bp, Rattus norvegicus
tttgcaagcactctcttgagccttt

SEQ ID NO: 693190 - DNA, 25 bp, Rattus norvegicus
tttgcaagcactgtcttgagccttt

SEQ ID NO: 693191 - DNA, 25 bp, Rattus norvegicus
tttgcaagcaggcatcagtccccgt

SEQ ID NO: 693192 - DNA, 25 bp, Rattus norvegicus
tttgcaagcagggatcagtccccgt

SEQ ID NO: 693193 - DNA, 25 bp, Rattus norvegicus
tttgcaagcctgctgccttcgggtt

SEQ ID NO: 693194 - DNA, 25 bp, Rattus norvegicus
tttgcaagcctggtgccttcgggtt

SEQ ID NO: 693195 - DNA, 25 bp, Rattus norvegicus
tttgcaagtttgaccctatatatag

SEQ ID NO: 693196 - DNA, 25 bp, Rattus norvegicus
tttgcaagtttgtccctatatatag

SEQ ID NO: 693197 - DNA, 25 bp, Rattus norvegicus
tttgcaatgccacagagaccagtat

SEQ ID NO: 693198 - DNA, 25 bp, Rattus norvegicus
tttgcaatgccagagagaccagtat

SEQ ID NO: 693199 - DNA, 25 bp, Rattus norvegicus
tttgcaatggtgctccagcacccaa

SEQ ID NO: 693200 - DNA, 25 bp, Rattus norvegicus
tttgcaatggtggtccagcacccaa

SEQ ID NO: 693201 - DNA, 25 bp, Rattus norvegicus
tttgcacaaacaagattctcccctg

SEQ ID NO: 693202 - DNA, 25 bp, Rattus norvegicus
tttgcacaaacatgattctcccctg

SEQ ID NO: 693203 - DNA, 25 bp, Rattus norvegicus
tttgcacaacatcgactcaagccag

SEQ ID NO: 693204 - DNA, 25 bp, Rattus norvegicus
tttgcacaacatggactcaagccag

SEQ ID NO: 693205 - DNA, 25 bp, Rattus norvegicus
tttgcacaacccctgacttcagaat

SEQ ID NO: 693206 - DNA, 25 bp, Rattus norvegicus
tttgcacaacccgtgacttcagaat

SEQ ID NO: 693207 - DNA, 25 bp, Rattus norvegicus
tttgcacaagcaatcggttctcagt

SEQ ID NO: 693208 - DNA, 25 bp, Rattus norvegicus
tttgcacaagcattcggttctcagt

SEQ ID NO: 693209 - DNA, 25 bp, Rattus norvegicus
tttgcacacacgctaaaattctcct

SEQ ID NO: 693210 - DNA, 25 bp, Rattus norvegicus
tttgcacacacggtaaaattctcct

SEQ ID NO: 693211 - DNA, 25 bp, Rattus norvegicus
tttgcacacccgatggagcagcaga

SEQ ID NO: 693212 - DNA, 25 bp, Rattus norvegicus
tttgcacacccgttggagcagcaga

SEQ ID NO: 693213 - DNA, 25 bp, Rattus norvegicus
tttgcacacctgaaatcgcggaatt

SEQ ID NO: 693214 - DNA, 25 bp, Rattus norvegicus
tttgcacacctgtaatcgcggaatt

SEQ ID NO: 693215 - DNA, 25 bp, Rattus norvegicus
tttgcacagagccagagacctatta

SEQ ID NO: 693216 - DNA, 25 bp, Rattus norvegicus
tttgcacagagcgagagacctatta

SEQ ID NO: 693217 - DNA, 25 bp, Rattus norvegicus
tttgcacatgacacctgggctcagg

SEQ ID NO: 693218 - DNA, 25 bp, Rattus norvegicus
tttgcacatgactcctgggctcagg

SEQ ID NO: 693219 - DNA, 25 bp, Rattus norvegicus
tttgcacattggcaagtgtcctcag

SEQ ID NO: 693220 - DNA, 25 bp, Rattus norvegicus
tttgcacattgggaagtgtcctcag

SEQ ID NO: 693221 - DNA, 25 bp, Rattus norvegicus
tttgcaccaaggactctggctgatt

SEQ ID NO: 693222 - DNA, 25 bp, Rattus norvegicus
tttgcaccaaggtctctggctgatt

SEQ ID NO: 693223 - DNA, 25 bp, Rattus norvegicus
tttgcaccaggtacttacagacgcc

SEQ ID NO: 693224 - DNA, 25 bp, Rattus norvegicus
tttgcaccaggttcttacagacgcc

SEQ ID NO: 693225 - DNA, 25 bp, Rattus norvegicus
tttgcaccagtcagtggtgctcagg

SEQ ID NO: 693226 - DNA, 25 bp, Rattus norvegicus
tttgcaccagtctgtggtgctcagg

SEQ ID NO: 693227 - DNA, 25 bp, Rattus norvegicus
tttgcaccatagacaatgccttcct

SEQ ID NO: 693228 - DNA, 25 bp, Rattus norvegicus
tttgcaccatagtcaatgccttcct

SEQ ID NO: 693229 - DNA, 25 bp, Rattus norvegicus
tttgcaccccagctgttgaagtggc

SEQ ID NO: 693230 - DNA, 25 bp, Rattus norvegicus
tttgcaccccaggtgttgaagtggc

SEQ ID NO: 693231 - DNA, 25 bp, Rattus norvegicus
tttgcacccctacaatgtcattttg

SEQ ID NO: 693232 - DNA, 25 bp, Rattus norvegicus
tttgcacccctagaatgtcattttg

SEQ ID NO: 693233 - DNA, 25 bp, Rattus norvegicus
tttgcacctgcacagtttcttcaga

SEQ ID NO: 693234 - DNA, 25 bp, Rattus norvegicus
tttgcacctgcagagtttcttcaga

SEQ ID NO: 693235 - DNA, 25 bp, Rattus norvegicus
tttgcacctgtgagtttccggtagt

SEQ ID NO: 693236 - DNA, 25 bp, Rattus norvegicus
tttgcacctgtgtgtttccggtagt

SEQ ID NO: 693237 - DNA, 25 bp, Rattus norvegicus
tttgcaccttaaaactggactactg

SEQ ID NO: 693238 - DNA, 25 bp, Rattus norvegicus
tttgcaccttaatactggactactg

SEQ ID NO: 693239 - DNA, 25 bp, Rattus norvegicus
tttgcaccttagaactgactggagg

SEQ ID NO: 693240 - DNA, 25 bp, Rattus norvegicus
tttgcaccttagtactgactggagg

SEQ ID NO: 693241 - DNA, 25 bp, Rattus norvegicus
tttgcaccttttcctgtagatttgt

SEQ ID NO: 693242 - DNA, 25 bp, Rattus norvegicus
tttgcaccttttgctgtagatttgt

SEQ ID NO: 693243 - DNA, 25 bp, Rattus norvegicus
tttgcacgaataccaactcctctgt

SEQ ID NO: 693244 - DNA, 25 bp, Rattus norvegicus
tttgcacgaatagcaactcctctgt

SEQ ID NO: 693245 - DNA, 25 bp, Rattus norvegicus
tttgcacgagacagcaccggaactt

SEQ ID NO: 693246 - DNA, 25 bp, Rattus norvegicus
tttgcacgagactgcaccggaactt

SEQ ID NO: 693247 - DNA, 25 bp, Rattus norvegicus
tttgcacgtacacgacagtcagcga

SEQ ID NO: 693248 - DNA, 25 bp, Rattus norvegicus
tttgcacgtacaggacagtcagcga

SEQ ID NO: 693249 - DNA, 25 bp, Rattus norvegicus
tttgcacgtcataattttccttttt

SEQ ID NO: 693250 - DNA, 25 bp, Rattus norvegicus
tttgcacgtcattattttccttttt

SEQ ID NO: 693251 - DNA, 25 bp, Rattus norvegicus
tttgcacgtgtgctactagtgggcc

SEQ ID NO: 693252 - DNA, 25 bp, Rattus norvegicus
tttgcacgtgtggtactagtgggcc

SEQ ID NO: 693253 - DNA, 25 bp, Rattus norvegicus
tttgcactaagtcatgctgtttcct

SEQ ID NO: 693254 - DNA, 25 bp, Rattus norvegicus
tttgcactaagtgatgctgtttcct

SEQ ID NO: 693255 - DNA, 25 bp, Rattus norvegicus
tttgcactacttaaacctgcctggg

SEQ ID NO: 693256 - DNA, 25 bp, Rattus norvegicus
tttgcactactttaacctgcctggg

SEQ ID NO: 693257 - DNA, 25 bp, Rattus norvegicus
tttgcactagaactagacgctcccc

SEQ ID NO: 693258 - DNA, 25 bp, Rattus norvegicus
tttgcactagaagtagacgctcccc

SEQ ID NO: 693259 - DNA, 25 bp, Rattus norvegicus
tttgcactagacctcaatacactgt

SEQ ID NO: 693260 - DNA, 25 bp, Rattus norvegicus
tttgcactagacgtcaatacactgt

SEQ ID NO: 693261 - DNA, 25 bp, Rattus norvegicus
tttgcactccagaccttggtatggg

SEQ ID NO: 693262 - DNA, 25 bp, Rattus norvegicus
tttgcactccagtccttggtatggg

SEQ ID NO: 693263 - DNA, 25 bp, Rattus norvegicus
tttgcactccggatttgagcttgta

SEQ ID NO: 693264 - DNA, 25 bp, Rattus norvegicus
tttgcactccggttttgagcttgta

SEQ ID NO: 693265 - DNA, 25 bp, Rattus norvegicus
tttgcactcgtgaccctgggatttt

SEQ ID NO: 693266 - DNA, 25 bp, Rattus norvegicus
tttgcactcgtgtccctgggatttt

SEQ ID NO: 693267 - DNA, 25 bp, Rattus norvegicus
tttgcactctttccagactcatgca

SEQ ID NO: 693268 - DNA, 25 bp, Rattus norvegicus
tttgcactctttgcagactcatgca

SEQ ID NO: 693269 - DNA, 25 bp, Rattus norvegicus
tttgcactgagaactttaaaacctt

SEQ ID NO: 693270 - DNA, 25 bp, Rattus norvegicus
tttgcactgagatctttaaaacctt

SEQ ID NO: 693271 - DNA, 25 bp, Rattus norvegicus
tttgcactggctagctgcttgtgaa

SEQ ID NO: 693272 - DNA, 25 bp, Rattus norvegicus
tttgcactggcttgctgcttgtgaa

SEQ ID NO: 693273 - DNA, 25 bp, Rattus norvegicus
tttgcacttacccaggatgttaatt

SEQ ID NO: 693274 - DNA, 25 bp, Rattus norvegicus
tttgcacttaccgaggatgttaatt

SEQ ID NO: 693275 - DNA, 25 bp, Rattus norvegicus
tttgcacttgatctagtcactttgc

SEQ ID NO: 693276 - DNA, 25 bp, Rattus norvegicus
tttgcacttgatgtagtcactttgc

SEQ ID NO: 693277 - DNA, 25 bp, Rattus norvegicus
tttgcactttggcaatgagtactga

SEQ ID NO: 693278 - DNA, 25 bp, Rattus norvegicus
tttgcactttgggaatgagtactga

SEQ ID NO: 693279 - DNA, 25 bp, Rattus norvegicus
tttgcactttttagaccgaaagctt

SEQ ID NO: 693280 - DNA, 25 bp, Rattus norvegicus
tttgcacttttttgaccgaaagctt

SEQ ID NO: 693281 - DNA, 25 bp, Rattus norvegicus
tttgcagaaaaaacccagcctcttc

SEQ ID NO: 693282 - DNA, 25 bp, Rattus norvegicus
tttgcagaaaaatcccagcctcttc

SEQ ID NO: 693283 - DNA, 25 bp, Rattus norvegicus
tttgcagaagttcggatcccttgtc

SEQ ID NO: 693284 - DNA, 25 bp, Rattus norvegicus
tttgcagaagttgggatcccttgtc

SEQ ID NO: 693285 - DNA, 25 bp, Rattus norvegicus
tttgcagacatcctcccgacaaata

SEQ ID NO: 693286 - DNA, 25 bp, Rattus norvegicus
tttgcagacatcgtcccgacaaata

SEQ ID NO: 693287 - DNA, 25 bp, Rattus norvegicus
tttgcagacattctccctcttggtg

SEQ ID NO: 693288 - DNA, 25 bp, Rattus norvegicus
tttgcagacattgtccctcttggtg

SEQ ID NO: 693289 - DNA, 25 bp, Rattus norvegicus
tttgcagactcacgatatatatatc

SEQ ID NO: 693290 - DNA, 25 bp, Rattus norvegicus
tttgcagactcaggatatatatatc

SEQ ID NO: 693291 - DNA, 25 bp, Rattus norvegicus
tttgcagagggcacttgctccagga

SEQ ID NO: 693292 - DNA, 25 bp, Rattus norvegicus
tttgcagagggctcttgctccagga

SEQ ID NO: 693293 - DNA, 25 bp, Rattus norvegicus
tttgcagagtgacccctacacaact

SEQ ID NO: 693294 - DNA, 25 bp, Rattus norvegicus
tttgcagagtgagccctacacaact

SEQ ID NO: 693295 - DNA, 25 bp, Rattus norvegicus
tttgcagataacagccaccgaggct

SEQ ID NO: 693296 - DNA, 25 bp, Rattus norvegicus
tttgcagataactgccaccgaggct

SEQ ID NO: 693297 - DNA, 25 bp, Rattus norvegicus
tttgcagatactacagattggtggt

SEQ ID NO: 693298 - DNA, 25 bp, Rattus norvegicus
tttgcagatacttcagattggtggt

SEQ ID NO: 693299 - DNA, 25 bp, Rattus norvegicus
tttgcagattggctaacacaggaac

SEQ ID NO: 693300 - DNA, 25 bp, Rattus norvegicus
tttgcagattgggtaacacaggaac

SEQ ID NO: 693301 - DNA, 25 bp, Rattus norvegicus
tttgcagcaagtatggccatggtac

SEQ ID NO: 693302 - DNA, 25 bp, Rattus norvegicus
tttgcagcaagtttggccatggtac

SEQ ID NO: 693303 - DNA, 25 bp, Rattus norvegicus
tttgcagcacctccactagaggtag

SEQ ID NO: 693304 - DNA, 25 bp, Rattus norvegicus
tttgcagcacctgcactagaggtag

SEQ ID NO: 693305 - DNA, 25 bp, Rattus norvegicus
tttgcagcacgtcaagcattcccac

SEQ ID NO: 693306 - DNA, 25 bp, Rattus norvegicus
tttgcagcacgtgaagcattcccac

SEQ ID NO: 693307 - DNA, 25 bp, Rattus norvegicus
tttgcagcactgatagttcccgtgg

SEQ ID NO: 693308 - DNA, 25 bp, Rattus norvegicus
tttgcagcactgttagttcccgtgg

SEQ ID NO: 693309 - DNA, 25 bp, Rattus norvegicus
tttgcagcatctagacctcagggaa

SEQ ID NO: 693310 - DNA, 25 bp, Rattus norvegicus
tttgcagcatcttgacctcagggaa

SEQ ID NO: 693311 - DNA, 25 bp, Rattus norvegicus
tttgcagcattcagtctgagcaggt

SEQ ID NO: 693312 - DNA, 25 bp, Rattus norvegicus
tttgcagcattctgtctgagcaggt

SEQ ID NO: 693313 - DNA, 25 bp, Rattus norvegicus
tttgcagccacgaccaaggatcttt

SEQ ID NO: 693314 - DNA, 25 bp, Rattus norvegicus
tttgcagccacgtccaaggatcttt

SEQ ID NO: 693315 - DNA, 25 bp, Rattus norvegicus
tttgcagccagcattccagctgaca

SEQ ID NO: 693316 - DNA, 25 bp, Rattus norvegicus
tttgcagccagctttccagctgaca

SEQ ID NO: 693317 - DNA, 25 bp, Rattus norvegicus
tttgcagcccaaataattttttaca

SEQ ID NO: 693318 - DNA, 25 bp, Rattus norvegicus
tttgcagcccaattaattttttaca

SEQ ID NO: 693319 - DNA, 25 bp, Rattus norvegicus
tttgcagcccagcttttctctccag

SEQ ID NO: 693320 - DNA, 25 bp, Rattus norvegicus
tttgcagcccaggttttctctccag

SEQ ID NO: 693321 - DNA, 25 bp, Rattus norvegicus
tttgcagccctcatgaactgtcgaa

SEQ ID NO: 693322 - DNA, 25 bp, Rattus norvegicus
tttgcagccctcttgaactgtcgaa

SEQ ID NO: 693323 - DNA, 25 bp, Rattus norvegicus
tttgcagccgctcagtagtcaaaag

SEQ ID NO: 693324 - DNA, 25 bp, Rattus norvegicus
tttgcagccgctgagtagtcaaaag

SEQ ID NO: 693325 - DNA, 25 bp, Rattus norvegicus
tttgcagcctctctctgtctcttag

SEQ ID NO: 693326 - DNA, 25 bp, Rattus norvegicus
tttgcagcctctgtctgtctcttag

SEQ ID NO: 693327 - DNA, 25 bp, Rattus norvegicus
tttgcagcctgtcttttcattgtca

SEQ ID NO: 693328 - DNA, 25 bp, Rattus norvegicus
tttgcagcctgtgttttcattgtca

SEQ ID NO: 693329 - DNA, 25 bp, Rattus norvegicus
tttgcagcgatgacattttcctcat

SEQ ID NO: 693330 - DNA, 25 bp, Rattus norvegicus
tttgcagcgatgtcattttcctcat

SEQ ID NO: 693331 - DNA, 25 bp, Rattus norvegicus
tttgcagctagcctttcgatagtct

SEQ ID NO: 693332 - DNA, 25 bp, Rattus norvegicus
tttgcagctagcgtttcgatagtct

SEQ ID NO: 693333 - DNA, 25 bp, Rattus norvegicus
tttgcagctatacaaaagcaggcct

SEQ ID NO: 693334 - DNA, 25 bp, Rattus norvegicus
tttgcagctatagaaaagcaggcct

SEQ ID NO: 693335 - DNA, 25 bp, Rattus norvegicus
tttgcagctgcccttttgtaagaag

SEQ ID NO: 693336 - DNA, 25 bp, Rattus norvegicus
tttgcagctgccgttttgtaagaag

SEQ ID NO: 693337 - DNA, 25 bp, Rattus norvegicus
tttgcagcttacctcactgtggtac

SEQ ID NO: 693338 - DNA, 25 bp, Rattus norvegicus
tttgcagcttacgtcactgtggtac

SEQ ID NO: 693339 - DNA, 25 bp, Rattus norvegicus
tttgcagcttgccgcggaatcacag

SEQ ID NO: 693340 - DNA, 25 bp, Rattus norvegicus
tttgcagcttgcggcggaatcacag

SEQ ID NO: 693341 - DNA, 25 bp, Rattus norvegicus
tttgcaggacctcaaactcccagtc

SEQ ID NO: 693342 - DNA, 25 bp, Rattus norvegicus
tttgcaggacctgaaactcccagtc

SEQ ID NO: 693343 - DNA, 25 bp, Rattus norvegicus
tttgcaggagcactttgtgtaggtt

SEQ ID NO: 693344 - DNA, 25 bp, Rattus norvegicus
tttgcaggagcagtttgtgtaggtt

SEQ ID NO: 693345 - DNA, 25 bp, Rattus norvegicus
tttgcaggagccaagctggaagcta

SEQ ID NO: 693346 - DNA, 25 bp, Rattus norvegicus
tttgcaggagcctagctggaagcta

SEQ ID NO: 693347 - DNA, 25 bp, Rattus norvegicus
tttgcaggctctcaccggcaaggaa

SEQ ID NO: 693348 - DNA, 25 bp, Rattus norvegicus
tttgcaggctctgaccggcaaggaa

SEQ ID NO: 693349 - DNA, 25 bp, Rattus norvegicus
tttgcaggtcataggccactgggac

SEQ ID NO: 693350 - DNA, 25 bp, Rattus norvegicus
tttgcaggtcattggccactgggac

SEQ ID NO: 693351 - DNA, 25 bp, Rattus norvegicus
tttgcaggtcgccaacgcacagtat

SEQ ID NO: 693352 - DNA, 25 bp, Rattus norvegicus
tttgcaggtcgcgaacgcacagtat

SEQ ID NO: 693353 - DNA, 25 bp, Rattus norvegicus
tttgcaggtcggctcattgagctac

SEQ ID NO: 693354 - DNA, 25 bp, Rattus norvegicus
tttgcaggtcgggtcattgagctac

SEQ ID NO: 693355 - DNA, 25 bp, Rattus norvegicus
tttgcaggttagctcgtagatctta

SEQ ID NO: 693356 - DNA, 25 bp, Rattus norvegicus
tttgcaggttaggtcgtagatctta

SEQ ID NO: 693357 - DNA, 25 bp, Rattus norvegicus
tttgcagtcagcctccagaggagga

SEQ ID NO: 693358 - DNA, 25 bp, Rattus norvegicus
tttgcagtcagcgtccagaggagga

SEQ ID NO: 693359 - DNA, 25 bp, Rattus norvegicus
tttgcagtcagtccctggcaccaat

SEQ ID NO: 693360 - DNA, 25 bp, Rattus norvegicus
tttgcagtcagtgcctggcaccaat

SEQ ID NO: 693361 - DNA, 25 bp, Rattus norvegicus
tttgcagtccttctcaaacacactc

SEQ ID NO: 693362 - DNA, 25 bp, Rattus norvegicus
tttgcagtccttgtcaaacacactc

SEQ ID NO: 693363 - DNA, 25 bp, Rattus norvegicus
tttgcagtctgcctctaattgttgg

SEQ ID NO: 693364 - DNA, 25 bp, Rattus norvegicus
tttgcagtctgcgtctaattgttgg

SEQ ID NO: 693365 - DNA, 25 bp, Rattus norvegicus
tttgcagtctgtctgtaataattca

SEQ ID NO: 693366 - DNA, 25 bp, Rattus norvegicus
tttgcagtctgtgtgtaataattca

SEQ ID NO: 693367 - DNA, 25 bp, Rattus norvegicus
tttgcagtgtttaccgccacagatc

SEQ ID NO: 693368 - DNA, 25 bp, Rattus norvegicus
tttgcagtgttttccgccacagatc

SEQ ID NO: 693369 - DNA, 25 bp, Rattus norvegicus
tttgcataatgcctacatccagtag

SEQ ID NO: 693370 - DNA, 25 bp, Rattus norvegicus
tttgcataatgcgtacatccagtag

SEQ ID NO: 693371 - DNA, 25 bp, Rattus norvegicus
tttgcataatgtaccctggccacag

SEQ ID NO: 693372 - DNA, 25 bp, Rattus norvegicus
tttgcataatgttccctggccacag

SEQ ID NO: 693373 - DNA, 25 bp, Rattus norvegicus
tttgcatactaacattggccctcat

SEQ ID NO: 693374 - DNA, 25 bp, Rattus norvegicus
tttgcatactaagattggccctcat

SEQ ID NO: 693375 - DNA, 25 bp, Rattus norvegicus
tttgcataggtcactggatcccact

SEQ ID NO: 693376 - DNA, 25 bp, Rattus norvegicus
tttgcataggtctctggatcccact

SEQ ID NO: 693377 - DNA, 25 bp, Rattus norvegicus
tttgcatatgagaacagtctagctg

SEQ ID NO: 693378 - DNA, 25 bp, Rattus norvegicus
tttgcatatgagtacagtctagctg

SEQ ID NO: 693379 - DNA, 25 bp, Rattus norvegicus
tttgcatcatcactgacatcacttc

SEQ ID NO: 693380 - DNA, 25 bp, Rattus norvegicus
tttgcatcatcagtgacatcacttc

SEQ ID NO: 693381 - DNA, 25 bp, Rattus norvegicus
tttgcatcattcaaccaagtcctct

SEQ ID NO: 693382 - DNA, 25 bp, Rattus norvegicus
tttgcatcattctaccaagtcctct

SEQ ID NO: 693383 - DNA, 25 bp, Rattus norvegicus
tttgcatccactaccatgataactg

SEQ ID NO: 693384 - DNA, 25 bp, Rattus norvegicus
tttgcatccacttccatgataactg

SEQ ID NO: 693385 - DNA, 25 bp, Rattus norvegicus
tttgcatccggcctctcgggtcttc

SEQ ID NO: 693386 - DNA, 25 bp, Rattus norvegicus
tttgcatccggcgtctcgggtcttc

SEQ ID NO: 693387 - DNA, 25 bp, Rattus norvegicus
tttgcatcctatcccaagtgacctc

SEQ ID NO: 693388 - DNA, 25 bp, Rattus norvegicus
tttgcatcctatgccaagtgacctc

SEQ ID NO: 693389 - DNA, 25 bp, Rattus norvegicus
tttgcatcctcccaatcttgagagt

SEQ ID NO: 693390 - DNA, 25 bp, Rattus norvegicus
tttgcatcctccgaatcttgagagt

SEQ ID NO: 693391 - DNA, 25 bp, Rattus norvegicus
tttgcatctggaaggttcggacact

SEQ ID NO: 693392 - DNA, 25 bp, Rattus norvegicus
tttgcatctggatggttcggacact

SEQ ID NO: 693393 - DNA, 25 bp, Rattus norvegicus
tttgcatgagcaccggagcgctccg

SEQ ID NO: 693394 - DNA, 25 bp, Rattus norvegicus
tttgcatgagcagcggagcgctccg

SEQ ID NO: 693395 - DNA, 25 bp, Rattus norvegicus
tttgcatgatccacccaggagcgct

SEQ ID NO: 693396 - DNA, 25 bp, Rattus norvegicus
tttgcatgatcctcccaggagcgct

SEQ ID NO: 693397 - DNA, 25 bp, Rattus norvegicus
tttgcatgccccatagaggccagaa

SEQ ID NO: 693398 - DNA, 25 bp, Rattus norvegicus
tttgcatgccccttagaggccagaa

SEQ ID NO: 693399 - DNA, 25 bp, Rattus norvegicus
tttgcatgccgacctgtgccggtct

SEQ ID NO: 693400 - DNA, 25 bp, Rattus norvegicus
tttgcatgccgagctgtgccggtct

SEQ ID NO: 693401 - DNA, 25 bp, Rattus norvegicus
tttgcatgtgaaaagttctacccag

SEQ ID NO: 693402 - DNA, 25 bp, Rattus norvegicus
tttgcatgtgaatagttctacccag

SEQ ID NO: 693403 - DNA, 25 bp, Rattus norvegicus
tttgcatgttccactaaccttgagc

SEQ ID NO: 693404 - DNA, 25 bp, Rattus norvegicus
tttgcatgttcctctaaccttgagc

SEQ ID NO: 693405 - DNA, 25 bp, Rattus norvegicus
tttgcattcagtcccttaatcgtcc

SEQ ID NO: 693406 - DNA, 25 bp, Rattus norvegicus
tttgcattcagtgccttaatcgtcc

SEQ ID NO: 693407 - DNA, 25 bp, Rattus norvegicus
tttgcattgaagcagtcactgtcgg

SEQ ID NO: 693408 - DNA, 25 bp, Rattus norvegicus
tttgcattgaaggagtcactgtcgg

SEQ ID NO: 693409 - DNA, 25 bp, Rattus norvegicus
tttgcattgcacacagcatctgtgt

SEQ ID NO: 693410 - DNA, 25 bp, Rattus norvegicus
tttgcattgcactcagcatctgtgt

SEQ ID NO: 693411 - DNA, 25 bp, Rattus norvegicus
tttgcattgcgcatgttcctgtaga

SEQ ID NO: 693412 - DNA, 25 bp, Rattus norvegicus
tttgcattgcgcttgttcctgtaga

SEQ ID NO: 693413 - DNA, 25 bp, Rattus norvegicus
tttgcatttctaatgcttttgtatg

SEQ ID NO: 693414 - DNA, 25 bp, Rattus norvegicus
tttgcatttctattgcttttgtatg

SEQ ID NO: 693415 - DNA, 25 bp, Rattus norvegicus
tttgcatttgctccaagcccataaa

SEQ ID NO: 693416 - DNA, 25 bp, Rattus norvegicus
tttgcatttgctgcaagcccataaa

SEQ ID NO: 693417 - DNA, 25 bp, Rattus norvegicus
tttgcattttctcctgaaacacaga

SEQ ID NO: 693418 - DNA, 25 bp, Rattus norvegicus
tttgcattttctgctgaaacacaga

SEQ ID NO: 693419 - DNA, 25 bp, Rattus norvegicus
tttgcatttttaaggcttctacagt

SEQ ID NO: 693420 - DNA, 25 bp, Rattus norvegicus
tttgcatttttatggcttctacagt

SEQ ID NO: 693421 - DNA, 25 bp, Rattus norvegicus
tttgccaaaagcaccagatccacag

SEQ ID NO: 693422 - DNA, 25 bp, Rattus norvegicus
tttgccaaaagctccagatccacag

SEQ ID NO: 693423 - DNA, 25 bp, Rattus norvegicus
tttgccaaaggcaggctggctcagc

SEQ ID NO: 693424 - DNA, 25 bp, Rattus norvegicus
tttgccaaaggctggctggctcagc

SEQ ID NO: 693425 - DNA, 25 bp, Rattus norvegicus
tttgccaacaccataatgtgcctct

SEQ ID NO: 693426 - DNA, 25 bp, Rattus norvegicus
tttgccaacaccttaatgtgcctct

SEQ ID NO: 693427 - DNA, 25 bp, Rattus norvegicus
tttgccaacattccctattcagtgg

SEQ ID NO: 693428 - DNA, 25 bp, Rattus norvegicus
tttgccaacattgcctattcagtgg

SEQ ID NO: 693429 - DNA, 25 bp, Rattus norvegicus
tttgccaactggaacttctttaaag

SEQ ID NO: 693430 - DNA, 25 bp, Rattus norvegicus
tttgccaactggtacttctttaaag

SEQ ID NO: 693431 - DNA, 25 bp, Rattus norvegicus
tttgccaactgtccctctgtttatc

SEQ ID NO: 693432 - DNA, 25 bp, Rattus norvegicus
tttgccaactgtgcctctgtttatc

SEQ ID NO: 693433 - DNA, 25 bp, Rattus norvegicus
tttgccaagggcatccgggacaccg

SEQ ID NO: 693434 - DNA, 25 bp, Rattus norvegicus
tttgccaagggcttccgggacaccg

SEQ ID NO: 693435 - DNA, 25 bp, Rattus norvegicus
tttgccaatttcattgtattcgtga

SEQ ID NO: 693436 - DNA, 25 bp, Rattus norvegicus
tttgccaatttctttgtattcgtga

SEQ ID NO: 693437 - DNA, 25 bp, Rattus norvegicus
tttgccacaagcaggtgttttcgaa

SEQ ID NO: 693438 - DNA, 25 bp, Rattus norvegicus
tttgccacaagctggtgttttcgaa

SEQ ID NO: 693439 - DNA, 25 bp, Rattus norvegicus
tttgccacaatacactaacggctgt

SEQ ID NO: 693440 - DNA, 25 bp, Rattus norvegicus
tttgccacaatagactaacggctgt

SEQ ID NO: 693441 - DNA, 25 bp, Rattus norvegicus
tttgccacaccacaccaagggaagg

SEQ ID NO: 693442 - DNA, 25 bp, Rattus norvegicus
tttgccacaccagaccaagggaagg

SEQ ID NO: 693443 - DNA, 25 bp, Rattus norvegicus
tttgccacacccactttaataaact

SEQ ID NO: 693444 - DNA, 25 bp, Rattus norvegicus
tttgccacaccctctttaataaact

SEQ ID NO: 693445 - DNA, 25 bp, Rattus norvegicus
tttgccacatagactcgggtgtccg

SEQ ID NO: 693446 - DNA, 25 bp, Rattus norvegicus
tttgccacatagtctcgggtgtccg

SEQ ID NO: 693447 - DNA, 25 bp, Rattus norvegicus
tttgccacatgccacaactggacat

SEQ ID NO: 693448 - DNA, 25 bp, Rattus norvegicus
tttgccacatgcgacaactggacat

SEQ ID NO: 693449 - DNA, 25 bp, Rattus norvegicus
tttgccacatgtctccatgatcttc

SEQ ID NO: 693450 - DNA, 25 bp, Rattus norvegicus
tttgccacatgtgtccatgatcttc

SEQ ID NO: 693451 - DNA, 25 bp, Rattus norvegicus
tttgccaccaaacagccccaaagat

SEQ ID NO: 693452 - DNA, 25 bp, Rattus norvegicus
tttgccaccaaagagccccaaagat

SEQ ID NO: 693453 - DNA, 25 bp, Rattus norvegicus
tttgccaccaggctgtgatgcgttg

SEQ ID NO: 693454 - DNA, 25 bp, Rattus norvegicus
tttgccaccagggtgtgatgcgttg

SEQ ID NO: 693455 - DNA, 25 bp, Rattus norvegicus
tttgccacctgacgccttggaagag

SEQ ID NO: 693456 - DNA, 25 bp, Rattus norvegicus
tttgccacctgaggccttggaagag

SEQ ID NO: 693457 - DNA, 25 bp, Rattus norvegicus
tttgccacctttaaggtttgagctt

SEQ ID NO: 693458 - DNA, 25 bp, Rattus norvegicus
tttgccaccttttaggtttgagctt

SEQ ID NO: 693459 - DNA, 25 bp, Rattus norvegicus
tttgccactcccagattccaagttc

SEQ ID NO: 693460 - DNA, 25 bp, Rattus norvegicus
tttgccactccctgattccaagttc

SEQ ID NO: 693461 - DNA, 25 bp, Rattus norvegicus
tttgccactggcagacgttttctga

SEQ ID NO: 693462 - DNA, 25 bp, Rattus norvegicus
tttgccactggctgacgttttctga

SEQ ID NO: 693463 - DNA, 25 bp, Rattus norvegicus
tttgccactttgctctgcctaagtt

SEQ ID NO: 693464 - DNA, 25 bp, Rattus norvegicus
tttgccactttggtctgcctaagtt

SEQ ID NO: 693465 - DNA, 25 bp, Rattus norvegicus
tttgccagaatcatcatgttatgtt

SEQ ID NO: 693466 - DNA, 25 bp, Rattus norvegicus
tttgccagaatcttcatgttatgtt

SEQ ID NO: 693467 - DNA, 25 bp, Rattus norvegicus
tttgccagagcacacagttgagaga

SEQ ID NO: 693468 - DNA, 25 bp, Rattus norvegicus
tttgccagagcagacagttgagaga

SEQ ID NO: 693469 - DNA, 25 bp, Rattus norvegicus
tttgccagatgaattgcccagtgtc

SEQ ID NO: 693470 - DNA, 25 bp, Rattus norvegicus
tttgccagatgatttgcccagtgtc

SEQ ID NO: 693471 - DNA, 25 bp, Rattus norvegicus
tttgccagcatacaaatgtaccaac

SEQ ID NO: 693472 - DNA, 25 bp, Rattus norvegicus
tttgccagcatagaaatgtaccaac

SEQ ID NO: 693473 - DNA, 25 bp, Rattus norvegicus
tttgccagccggacgcagctcgatg

SEQ ID NO: 693474 - DNA, 25 bp, Rattus norvegicus
tttgccagccggcacaatcaggaca

SEQ ID NO: 693475 - DNA, 25 bp, Rattus norvegicus
tttgccagccgggacaatcaggaca

SEQ ID NO: 693476 - DNA, 25 bp, Rattus norvegicus
tttgccagccggtcgcagctcgatg

SEQ ID NO: 693477 - DNA, 25 bp, Rattus norvegicus
tttgccagcgttccctgtactatag

SEQ ID NO: 693478 - DNA, 25 bp, Rattus norvegicus
tttgccagcgttgcctgtactatag

SEQ ID NO: 693479 - DNA, 25 bp, Rattus norvegicus
tttgccagctctcaggcataccagt

SEQ ID NO: 693480 - DNA, 25 bp, Rattus norvegicus
tttgccagctctgaggcataccagt

SEQ ID NO: 693481 - DNA, 25 bp, Rattus norvegicus
tttgccaggaaacggcccagtactg

SEQ ID NO: 693482 - DNA, 25 bp, Rattus norvegicus
tttgccaggaaagggcccagtactg

SEQ ID NO: 693483 - DNA, 25 bp, Rattus norvegicus
tttgccaggaagcagagccccttgc

SEQ ID NO: 693484 - DNA, 25 bp, Rattus norvegicus
tttgccaggaaggagagccccttgc

SEQ ID NO: 693485 - DNA, 25 bp, Rattus norvegicus
tttgccaggaatctctgccttgttc

SEQ ID NO: 693486 - DNA, 25 bp, Rattus norvegicus
tttgccaggaatgtctgccttgttc

SEQ ID NO: 693487 - DNA, 25 bp, Rattus norvegicus
tttgccaggacgcacagagtcgatc

SEQ ID NO: 693488 - DNA, 25 bp, Rattus norvegicus
tttgccaggacggacagagtcgatc

SEQ ID NO: 693489 - DNA, 25 bp, Rattus norvegicus
tttgccaggagccttttcccgacgg

SEQ ID NO: 693490 - DNA, 25 bp, Rattus norvegicus
tttgccaggagcgttttcccgacgg

SEQ ID NO: 693491 - DNA, 25 bp, Rattus norvegicus
tttgccagggcaccaaggacttgta

SEQ ID NO: 693492 - DNA, 25 bp, Rattus norvegicus
tttgccagggcagcaaggacttgta

SEQ ID NO: 693493 - DNA, 25 bp, Rattus norvegicus
tttgccagggctctccctgggccat

SEQ ID NO: 693494 - DNA, 25 bp, Rattus norvegicus
tttgccagggctgtccctgggccat

SEQ ID NO: 693495 - DNA, 25 bp, Rattus norvegicus
tttgccagtagacggcagcactgcc

SEQ ID NO: 693496 - DNA, 25 bp, Rattus norvegicus
tttgccagtagagggcagcactgcc

SEQ ID NO: 693497 - DNA, 25 bp, Rattus norvegicus
tttgccagtctcagacccaaacatg

SEQ ID NO: 693498 - DNA, 25 bp, Rattus norvegicus
tttgccagtctctgacccaaacatg

SEQ ID NO: 693499 - DNA, 25 bp, Rattus norvegicus
tttgccagtggaaggagctgctgct

SEQ ID NO: 693500 - DNA, 25 bp, Rattus norvegicus
tttgccagtggatggagctgctgct

SEQ ID NO: 693501 - DNA, 25 bp, Rattus norvegicus
tttgccataaccattgtgccagtca

SEQ ID NO: 693502 - DNA, 25 bp, Rattus norvegicus
tttgccataacctttgtgccagtca

SEQ ID NO: 693503 - DNA, 25 bp, Rattus norvegicus
tttgccataagcctatccagttcat

SEQ ID NO: 693504 - DNA, 25 bp, Rattus norvegicus
tttgccataagcgtatccagttcat

SEQ ID NO: 693505 - DNA, 25 bp, Rattus norvegicus
tttgccatcatgctctaagactttt

SEQ ID NO: 693506 - DNA, 25 bp, Rattus norvegicus
tttgccatcatggtctaagactttt

SEQ ID NO: 693507 - DNA, 25 bp, Rattus norvegicus
tttgccatggttagttcccacagta

SEQ ID NO: 693508 - DNA, 25 bp, Rattus norvegicus
tttgccatggttattcctcaggtcc

SEQ ID NO: 693509 - DNA, 25 bp, Rattus norvegicus
tttgccatggtttgttcccacagta

SEQ ID NO: 693510 - DNA, 25 bp, Rattus norvegicus
tttgccatggtttttcctcaggtcc

SEQ ID NO: 693511 - DNA, 25 bp, Rattus norvegicus
tttgccatgtatcgcccgtagtgcc

SEQ ID NO: 693512 - DNA, 25 bp, Rattus norvegicus
tttgccatgtatggcccgtagtgcc

SEQ ID NO: 693513 - DNA, 25 bp, Rattus norvegicus
tttgccatgtctatgagcctgtctc

SEQ ID NO: 693514 - DNA, 25 bp, Rattus norvegicus
tttgccatgtctttgagcctgtctc

SEQ ID NO: 693515 - DNA, 25 bp, Rattus norvegicus
tttgccatgtgtcccttggaagagg

SEQ ID NO: 693516 - DNA, 25 bp, Rattus norvegicus
tttgccatgtgtgccttggaagagg

SEQ ID NO: 693517 - DNA, 25 bp, Rattus norvegicus
tttgccatgttgatcacgggtcctt

SEQ ID NO: 693518 - DNA, 25 bp, Rattus norvegicus
tttgccatgttgttcacgggtcctt

SEQ ID NO: 693519 - DNA, 25 bp, Rattus norvegicus
tttgccattaaccaggttcctgtga

SEQ ID NO: 693520 - DNA, 25 bp, Rattus norvegicus
tttgccattaacgaggttcctgtga

SEQ ID NO: 693521 - DNA, 25 bp, Rattus norvegicus
tttgccattcaactgatgctccaga

SEQ ID NO: 693522 - DNA, 25 bp, Rattus norvegicus
tttgccattcaagtgatgctccaga

SEQ ID NO: 693523 - DNA, 25 bp, Rattus norvegicus
tttgcccaaacgattcccatgtcac

SEQ ID NO: 693524 - DNA, 25 bp, Rattus norvegicus
tttgcccaaacgtttcccatgtcac

SEQ ID NO: 693525 - DNA, 25 bp, Rattus norvegicus
tttgcccaagctcgcgagggtctgc

SEQ ID NO: 693526 - DNA, 25 bp, Rattus norvegicus
tttgcccaagctggcgagggtctgc

SEQ ID NO: 693527 - DNA, 25 bp, Rattus norvegicus
tttgcccaagtcagtgtctatacca

SEQ ID NO: 693528 - DNA, 25 bp, Rattus norvegicus
tttgcccaagtctgtgtctatacca

SEQ ID NO: 693529 - DNA, 25 bp, Rattus norvegicus
tttgcccacagtagcttccggaagc

SEQ ID NO: 693530 - DNA, 25 bp, Rattus norvegicus
tttgcccacagttgcttccggaagc

SEQ ID NO: 693531 - DNA, 25 bp, Rattus norvegicus
tttgcccaccacagttgattattcg

SEQ ID NO: 693532 - DNA, 25 bp, Rattus norvegicus
tttgcccaccactgttgattattcg

SEQ ID NO: 693533 - DNA, 25 bp, Rattus norvegicus
tttgcccaccatcattctcattatt

SEQ ID NO: 693534 - DNA, 25 bp, Rattus norvegicus
tttgcccaccatgattctcattatt

SEQ ID NO: 693535 - DNA, 25 bp, Rattus norvegicus
tttgcccacctacaacgaacgggag

SEQ ID NO: 693536 - DNA, 25 bp, Rattus norvegicus
tttgcccacctactttttcaggagg

SEQ ID NO: 693537 - DNA, 25 bp, Rattus norvegicus
tttgcccacctagaacgaacgggag

SEQ ID NO: 693538 - DNA, 25 bp, Rattus norvegicus
tttgcccacctagtttttcaggagg

SEQ ID NO: 693539 - DNA, 25 bp, Rattus norvegicus
tttgcccacgttacctgcagatcag

SEQ ID NO: 693540 - DNA, 25 bp, Rattus norvegicus
tttgcccacgtttcctgcagatcag

SEQ ID NO: 693541 - DNA, 25 bp, Rattus norvegicus
tttgcccagaaccagctggttattt

SEQ ID NO: 693542 - DNA, 25 bp, Rattus norvegicus
tttgcccagaacgagctggttattt

SEQ ID NO: 693543 - DNA, 25 bp, Rattus norvegicus
tttgcccagaagcacaccaccgtgg

SEQ ID NO: 693544 - DNA, 25 bp, Rattus norvegicus
tttgcccagaaggacaccaccgtgg

SEQ ID NO: 693545 - DNA, 25 bp, Rattus norvegicus
tttgcccagagcacggaggtagatg

SEQ ID NO: 693546 - DNA, 25 bp, Rattus norvegicus
tttgcccagagcatggatacatcct

SEQ ID NO: 693547 - DNA, 25 bp, Rattus norvegicus
tttgcccagagctcggaggtagatg

SEQ ID NO: 693548 - DNA, 25 bp, Rattus norvegicus
tttgcccagagcttggatacatcct

SEQ ID NO: 693549 - DNA, 25 bp, Rattus norvegicus
tttgcccagcttataccttcctgta

SEQ ID NO: 693550 - DNA, 25 bp, Rattus norvegicus
tttgcccagcttttaccttcctgta

SEQ ID NO: 693551 - DNA, 25 bp, Rattus norvegicus
tttgcccaggcccaatgacatggtg

SEQ ID NO: 693552 - DNA, 25 bp, Rattus norvegicus
tttgcccaggccgaatgacatggtg

SEQ ID NO: 693553 - DNA, 25 bp, Rattus norvegicus
tttgcccagtagcatgagacaactt

SEQ ID NO: 693554 - DNA, 25 bp, Rattus norvegicus
tttgcccagtaggatgagacaactt

SEQ ID NO: 693555 - DNA, 25 bp, Rattus norvegicus
tttgcccatcacacggtttgtgtta

SEQ ID NO: 693556 - DNA, 25 bp, Rattus norvegicus
tttgcccatcactcggtttgtgtta

SEQ ID NO: 693557 - DNA, 25 bp, Rattus norvegicus
tttgcccatcctaaagttggacctg

SEQ ID NO: 693558 - DNA, 25 bp, Rattus norvegicus
tttgcccatccttaagttggacctg

SEQ ID NO: 693559 - DNA, 25 bp, Rattus norvegicus
tttgcccatgacctttgttactgaa

SEQ ID NO: 693560 - DNA, 25 bp, Rattus norvegicus
tttgcccatgacgtttgttactgaa

SEQ ID NO: 693561 - DNA, 25 bp, Rattus norvegicus
tttgccccacgtagatgttttctta

SEQ ID NO: 693562 - DNA, 25 bp, Rattus norvegicus
tttgccccacgttgatgttttctta

SEQ ID NO: 693563 - DNA, 25 bp, Rattus norvegicus
tttgccccagaaccccaacccaatt

SEQ ID NO: 693564 - DNA, 25 bp, Rattus norvegicus
tttgccccagaagcccaacccaatt

SEQ ID NO: 693565 - DNA, 25 bp, Rattus norvegicus
tttgccccaggaaagcggatgtgcc

SEQ ID NO: 693566 - DNA, 25 bp, Rattus norvegicus
tttgccccaggatagcggatgtgcc

SEQ ID NO: 693567 - DNA, 25 bp, Rattus norvegicus
tttgccccagtgagatgcagctgct

SEQ ID NO: 693568 - DNA, 25 bp, Rattus norvegicus
tttgccccagtgtgatgcagctgct

SEQ ID NO: 693569 - DNA, 25 bp, Rattus norvegicus
tttgccccagttattagaaggacat

SEQ ID NO: 693570 - DNA, 25 bp, Rattus norvegicus
tttgccccagtttttagaaggacat

SEQ ID NO: 693571 - DNA, 25 bp, Rattus norvegicus
tttgccccggccagtggtcatgagc

SEQ ID NO: 693572 - DNA, 25 bp, Rattus norvegicus
tttgccccggcctgtggtcatgagc

SEQ ID NO: 693573 - DNA, 25 bp, Rattus norvegicus
tttgccccgggtattatcaagatag

SEQ ID NO: 693574 - DNA, 25 bp, Rattus norvegicus
tttgccccgggttttatcaagatag

SEQ ID NO: 693575 - DNA, 25 bp, Rattus norvegicus
tttgcccctaccattcatagtagag

SEQ ID NO: 693576 - DNA, 25 bp, Rattus norvegicus
tttgcccctacctttcatagtagag

SEQ ID NO: 693577 - DNA, 25 bp, Rattus norvegicus
tttgcccctcaaaagctatattcta

SEQ ID NO: 693578 - DNA, 25 bp, Rattus norvegicus
tttgcccctcaatagctatattcta

SEQ ID NO: 693579 - DNA, 25 bp, Rattus norvegicus
tttgcccctgtaagtctttgtgcac

SEQ ID NO: 693580 - DNA, 25 bp, Rattus norvegicus
tttgcccctgtatgtctttgtgcac

SEQ ID NO: 693581 - DNA, 25 bp, Rattus norvegicus
tttgccccttccagagggaaagaca

SEQ ID NO: 693582 - DNA, 25 bp, Rattus norvegicus
tttgccccttcctgagggaaagaca

SEQ ID NO: 693583 - DNA, 25 bp, Rattus norvegicus
tttgccccttctcacgatagatgat

SEQ ID NO: 693584 - DNA, 25 bp, Rattus norvegicus
tttgccccttctgacgatagatgat

SEQ ID NO: 693585 - DNA, 25 bp, Rattus norvegicus
tttgcccgaatgcacgcgtaagtgt

SEQ ID NO: 693586 - DNA, 25 bp, Rattus norvegicus
tttgcccgaatggacgcgtaagtgt

SEQ ID NO: 693587 - DNA, 25 bp, Rattus norvegicus
tttgcccgactcactgagtcatttt

SEQ ID NO: 693588 - DNA, 25 bp, Rattus norvegicus
tttgcccgactctctgagtcatttt

SEQ ID NO: 693589 - DNA, 25 bp, Rattus norvegicus
tttgcccgtgtgacactcttgcacc

SEQ ID NO: 693590 - DNA, 25 bp, Rattus norvegicus
tttgcccgtgtgtcactcttgcacc

SEQ ID NO: 693591 - DNA, 25 bp, Rattus norvegicus
tttgccctacctatcacagacaggt

SEQ ID NO: 693592 - DNA, 25 bp, Rattus norvegicus
tttgccctacctttcacagacaggt

SEQ ID NO: 693593 - DNA, 25 bp, Rattus norvegicus
tttgccctagtgagtcttcacagta

SEQ ID NO: 693594 - DNA, 25 bp, Rattus norvegicus
tttgccctagtgtgtcttcacagta

SEQ ID NO: 693595 - DNA, 25 bp, Rattus norvegicus
tttgccctatctctgtatttcttta

SEQ ID NO: 693596 - DNA, 25 bp, Rattus norvegicus
tttgccctatctgtgtatttcttta

SEQ ID NO: 693597 - DNA, 25 bp, Rattus norvegicus
tttgccctctgaccctgcagggaaa

SEQ ID NO: 693598 - DNA, 25 bp, Rattus norvegicus
tttgccctctgagcctgcagggaaa

SEQ ID NO: 693599 - DNA, 25 bp, Rattus norvegicus
tttgccctctgtatccagtttcttg

SEQ ID NO: 693600 - DNA, 25 bp, Rattus norvegicus
tttgccctctgtttccagtttcttg

SEQ ID NO: 693601 - DNA, 25 bp, Rattus norvegicus
tttgccctctttcagtattatgcct

SEQ ID NO: 693602 - DNA, 25 bp, Rattus norvegicus
tttgccctctttgagtattatgcct

SEQ ID NO: 693603 - DNA, 25 bp, Rattus norvegicus
tttgccctgatgcttgttttataca

SEQ ID NO: 693604 - DNA, 25 bp, Rattus norvegicus
tttgccctgatggttgttttataca

SEQ ID NO: 693605 - DNA, 25 bp, Rattus norvegicus
tttgccctgattccaagcgttctga

SEQ ID NO: 693606 - DNA, 25 bp, Rattus norvegicus
tttgccctgattgcaagcgttctga

SEQ ID NO: 693607 - DNA, 25 bp, Rattus norvegicus
tttgccctgcctattattaaatgga

SEQ ID NO: 693608 - DNA, 25 bp, Rattus norvegicus
tttgccctgccttttattaaatgga

SEQ ID NO: 693609 - DNA, 25 bp, Rattus norvegicus
tttgccctggtacactctgaccatg

SEQ ID NO: 693610 - DNA, 25 bp, Rattus norvegicus
tttgccctggtagactctgaccatg

SEQ ID NO: 693611 - DNA, 25 bp, Rattus norvegicus
tttgccctgtatctgctgagcaaga

SEQ ID NO: 693612 - DNA, 25 bp, Rattus norvegicus
tttgccctgtatgtgctgagcaaga

SEQ ID NO: 693613 - DNA, 25 bp, Rattus norvegicus
tttgcccttagtacacttgtcattt

SEQ ID NO: 693614 - DNA, 25 bp, Rattus norvegicus
tttgcccttagttcacttgtcattt

SEQ ID NO: 693615 - DNA, 25 bp, Rattus norvegicus
tttgcccttcacactccatgcgtgt

SEQ ID NO: 693616 - DNA, 25 bp, Rattus norvegicus
tttgcccttcactctccatgcgtgt

SEQ ID NO: 693617 - DNA, 25 bp, Rattus norvegicus
tttgcccttccgattgtggtcatta

SEQ ID NO: 693618 - DNA, 25 bp, Rattus norvegicus
tttgcccttccgtttgtggtcatta

SEQ ID NO: 693619 - DNA, 25 bp, Rattus norvegicus
tttgcccttcttacttactattact

SEQ ID NO: 693620 - DNA, 25 bp, Rattus norvegicus
tttgcccttctttcttactattact

SEQ ID NO: 693621 - DNA, 25 bp, Rattus norvegicus
tttgcccttgcaaatgtctatgcag

SEQ ID NO: 693622 - DNA, 25 bp, Rattus norvegicus
tttgcccttgcatatgtctatgcag

SEQ ID NO: 693623 - DNA, 25 bp, Rattus norvegicus
tttgccctttgcagtttggttcaac

SEQ ID NO: 693624 - DNA, 25 bp, Rattus norvegicus
tttgccctttgctgtttggttcaac

SEQ ID NO: 693625 - DNA, 25 bp, Rattus norvegicus
tttgccctttgtaccaagagactga

SEQ ID NO: 693626 - DNA, 25 bp, Rattus norvegicus
tttgccctttgttccaagagactga

SEQ ID NO: 693627 - DNA, 25 bp, Rattus norvegicus
tttgccgaaccaagtaccagtgcac

SEQ ID NO: 693628 - DNA, 25 bp, Rattus norvegicus
tttgccgaaccatgtaccagtgcac

SEQ ID NO: 693629 - DNA, 25 bp, Rattus norvegicus
tttgccgaatccacattactcacta

SEQ ID NO: 693630 - DNA, 25 bp, Rattus norvegicus
tttgccgaatcctcattactcacta

SEQ ID NO: 693631 - DNA, 25 bp, Rattus norvegicus
tttgccgaggccaccgtgcccaaaa

SEQ ID NO: 693632 - DNA, 25 bp, Rattus norvegicus
tttgccgaggccactttcgggagga

SEQ ID NO: 693633 - DNA, 25 bp, Rattus norvegicus
tttgccgaggcctccgtgcccaaaa

SEQ ID NO: 693634 - DNA, 25 bp, Rattus norvegicus
tttgccgaggcctctttcgggagga

SEQ ID NO: 693635 - DNA, 25 bp, Rattus norvegicus
tttgccgatgatcctgtcagactca

SEQ ID NO: 693636 - DNA, 25 bp, Rattus norvegicus
tttgccgatgatgctgtcagactca

SEQ ID NO: 693637 - DNA, 25 bp, Rattus norvegicus
tttgccgccgagagcctcgtgtcca

SEQ ID NO: 693638 - DNA, 25 bp, Rattus norvegicus
tttgccgccgagtgcctcgtgtcca

SEQ ID NO: 693639 - DNA, 25 bp, Rattus norvegicus
tttgccgcctgcaggatgcctttta

SEQ ID NO: 693640 - DNA, 25 bp, Rattus norvegicus
tttgccgcctgctggatgcctttta

SEQ ID NO: 693641 - DNA, 25 bp, Rattus norvegicus
tttgccgcgagtcttggccacattt

SEQ ID NO: 693642 - DNA, 25 bp, Rattus norvegicus
tttgccgcgagtgttggccacattt

SEQ ID NO: 693643 - DNA, 25 bp, Rattus norvegicus
tttgccgcgctacgaactttgggac

SEQ ID NO: 693644 - DNA, 25 bp, Rattus norvegicus
tttgccgcgctaggaactttgggac

SEQ ID NO: 693645 - DNA, 25 bp, Rattus norvegicus
tttgccgctgcaacaataactgggt

SEQ ID NO: 693646 - DNA, 25 bp, Rattus norvegicus
tttgccgctgcatcaataactgggt

SEQ ID NO: 693647 - DNA, 25 bp, Rattus norvegicus
tttgccggccaaactcctgaagaag

SEQ ID NO: 693648 - DNA, 25 bp, Rattus norvegicus
tttgccggccaatctcctgaagaag

SEQ ID NO: 693649 - DNA, 25 bp, Rattus norvegicus
tttgccggtcacaagaccatgttgt

SEQ ID NO: 693650 - DNA, 25 bp, Rattus norvegicus
tttgccggtcactagaccatgttgt

SEQ ID NO: 693651 - DNA, 25 bp, Rattus norvegicus
tttgccgtgcaaaaggtcccagatt

SEQ ID NO: 693652 - DNA, 25 bp, Rattus norvegicus
tttgccgtgcaataggtcccagatt

SEQ ID NO: 693653 - DNA, 25 bp, Rattus norvegicus
tttgccgttacaaatccttccctca

SEQ ID NO: 693654 - DNA, 25 bp, Rattus norvegicus
tttgccgttacatatccttccctca

SEQ ID NO: 693655 - DNA, 25 bp, Rattus norvegicus
tttgccgttcagatgaatgtagcca

SEQ ID NO: 693656 - DNA, 25 bp, Rattus norvegicus
tttgccgttcagttgaatgtagcca

SEQ ID NO: 693657 - DNA, 25 bp, Rattus norvegicus
tttgccgttggccttcatataagaa

SEQ ID NO: 693658 - DNA, 25 bp, Rattus norvegicus
tttgccgttggcgttcatataagaa

SEQ ID NO: 693659 - DNA, 25 bp, Rattus norvegicus
tttgcctaaagcctcacggatgatt

SEQ ID NO: 693660 - DNA, 25 bp, Rattus norvegicus
tttgcctaaagcgtcacggatgatt

SEQ ID NO: 693661 - DNA, 25 bp, Rattus norvegicus
tttgcctacttcatctggattgcca

SEQ ID NO: 693662 - DNA, 25 bp, Rattus norvegicus
tttgcctacttcttctggattgcca

SEQ ID NO: 693663 - DNA, 25 bp, Rattus norvegicus
tttgcctagtcaatgttggttacga

SEQ ID NO: 693664 - DNA, 25 bp, Rattus norvegicus
tttgcctagtcattgttggttacga

SEQ ID NO: 693665 - DNA, 25 bp, Rattus norvegicus
tttgcctagtgcacccacactaaat

SEQ ID NO: 693666 - DNA, 25 bp, Rattus norvegicus
tttgcctagtgctcccacactaaat

SEQ ID NO: 693667 - DNA, 25 bp, Rattus norvegicus
tttgcctataccactgtggttcagg

SEQ ID NO: 693668 - DNA, 25 bp, Rattus norvegicus
tttgcctatacctctgtggttcagg

SEQ ID NO: 693669 - DNA, 25 bp, Rattus norvegicus
tttgcctatactcaaagtactggag

SEQ ID NO: 693670 - DNA, 25 bp, Rattus norvegicus
tttgcctatactgaaagtactggag

SEQ ID NO: 693671 - DNA, 25 bp, Rattus norvegicus
tttgcctatattatcctggtagcag

SEQ ID NO: 693672 - DNA, 25 bp, Rattus norvegicus
tttgcctatattttcctggtagcag

SEQ ID NO: 693673 - DNA, 25 bp, Rattus norvegicus
tttgcctcaaagacctagagctgga

SEQ ID NO: 693674 - DNA, 25 bp, Rattus norvegicus
tttgcctcaaagtcctagagctgga

SEQ ID NO: 693675 - DNA, 25 bp, Rattus norvegicus
tttgcctcaaatccattccaagttg

SEQ ID NO: 693676 - DNA, 25 bp, Rattus norvegicus
tttgcctcaaatgcattccaagttg

SEQ ID NO: 693677 - DNA, 25 bp, Rattus norvegicus
tttgcctcaggcagcatatggacag

SEQ ID NO: 693678 - DNA, 25 bp, Rattus norvegicus
tttgcctcaggctgcatatggacag

SEQ ID NO: 693679 - DNA, 25 bp, Rattus norvegicus
tttgcctcatgaacactggctgcaa

SEQ ID NO: 693680 - DNA, 25 bp, Rattus norvegicus
tttgcctcatgatcactggctgcaa

SEQ ID NO: 693681 - DNA, 25 bp, Rattus norvegicus
tttgcctccactatgaattgcgaat

SEQ ID NO: 693682 - DNA, 25 bp, Rattus norvegicus
tttgcctccactttgaattgcgaat

SEQ ID NO: 693683 - DNA, 25 bp, Rattus norvegicus
tttgcctcccgtcgtatcagagcga

SEQ ID NO: 693684 - DNA, 25 bp, Rattus norvegicus
tttgcctcccgtggtatcagagcga

SEQ ID NO: 693685 - DNA, 25 bp, Rattus norvegicus
tttgcctccgtgagtgtattcatgt

SEQ ID NO: 693686 - DNA, 25 bp, Rattus norvegicus
tttgcctccgtgtgtgtattcatgt

SEQ ID NO: 693687 - DNA, 25 bp, Rattus norvegicus
tttgcctctaacagccttttcaaag

SEQ ID NO: 693688 - DNA, 25 bp, Rattus norvegicus
tttgcctctaactgccttttcaaag

SEQ ID NO: 693689 - DNA, 25 bp, Rattus norvegicus
tttgcctctaatattgtttgtttct

SEQ ID NO: 693690 - DNA, 25 bp, Rattus norvegicus
tttgcctctaattttgtttgtttct

SEQ ID NO: 693691 - DNA, 25 bp, Rattus norvegicus
tttgcctctgaacttgatctacctg

SEQ ID NO: 693692 - DNA, 25 bp, Rattus norvegicus
tttgcctctgaagttgatctacctg

SEQ ID NO: 693693 - DNA, 25 bp, Rattus norvegicus
tttgcctctgttcatgacgccgtga

SEQ ID NO: 693694 - DNA, 25 bp, Rattus norvegicus
tttgcctctgttgatgacgccgtga

SEQ ID NO: 693695 - DNA, 25 bp, Rattus norvegicus
tttgcctgagacataaagccttttc

SEQ ID NO: 693696 - DNA, 25 bp, Rattus norvegicus
tttgcctgagacttaaagccttttc

SEQ ID NO: 693697 - DNA, 25 bp, Rattus norvegicus
tttgcctgagttatcttctactgat

SEQ ID NO: 693698 - DNA, 25 bp, Rattus norvegicus
tttgcctgagttttcttctactgat

SEQ ID NO: 693699 - DNA, 25 bp, Rattus norvegicus
tttgcctgatgactgaagacctacg

SEQ ID NO: 693700 - DNA, 25 bp, Rattus norvegicus
tttgcctgatgagtgaagacctacg

SEQ ID NO: 693701 - DNA, 25 bp, Rattus norvegicus
tttgcctgcaccaggccgggctgcg

SEQ ID NO: 693702 - DNA, 25 bp, Rattus norvegicus
tttgcctgcacctggccgggctgcg

SEQ ID NO: 693703 - DNA, 25 bp, Rattus norvegicus
tttgcctgcgttacatgcacatgca

SEQ ID NO: 693704 - DNA, 25 bp, Rattus norvegicus
tttgcctgcgtttcatgcacatgca

SEQ ID NO: 693705 - DNA, 25 bp, Rattus norvegicus
tttgcctggcagatctgcattgcat

SEQ ID NO: 693706 - DNA, 25 bp, Rattus norvegicus
tttgcctggcagttctgcattgcat

SEQ ID NO: 693707 - DNA, 25 bp, Rattus norvegicus
tttgcctggcccattggttcccaag

SEQ ID NO: 693708 - DNA, 25 bp, Rattus norvegicus
tttgcctggccctttggttcccaag

SEQ ID NO: 693709 - DNA, 25 bp, Rattus norvegicus
tttgcctggcgcatctgagtcagtc

SEQ ID NO: 693710 - DNA, 25 bp, Rattus norvegicus
tttgcctggcgcttctgagtcagtc

SEQ ID NO: 693711 - DNA, 25 bp, Rattus norvegicus
tttgcctggcttcagtgaaaccctg

SEQ ID NO: 693712 - DNA, 25 bp, Rattus norvegicus
tttgcctggcttgagtgaaaccctg

SEQ ID NO: 693713 - DNA, 25 bp, Rattus norvegicus
tttgcctgtgacaattgtggccgta

SEQ ID NO: 693714 - DNA, 25 bp, Rattus norvegicus
tttgcctgtgactattgtggccgta

SEQ ID NO: 693715 - DNA, 25 bp, Rattus norvegicus
tttgcctgtggtatctattatctaa

SEQ ID NO: 693716 - DNA, 25 bp, Rattus norvegicus
tttgcctgtggtttctattatctaa

SEQ ID NO: 693717 - DNA, 25 bp, Rattus norvegicus
tttgcctgtgtccacggaactacag

SEQ ID NO: 693718 - DNA, 25 bp, Rattus norvegicus
tttgcctgtgtcgacggaactacag

SEQ ID NO: 693719 - DNA, 25 bp, Rattus norvegicus
tttgccttaaataagctcgctgtcc

SEQ ID NO: 693720 - DNA, 25 bp, Rattus norvegicus
tttgccttaaattagctcgctgtcc

SEQ ID NO: 693721 - DNA, 25 bp, Rattus norvegicus
tttgccttacatcatcaagtgggcc

SEQ ID NO: 693722 - DNA, 25 bp, Rattus norvegicus
tttgccttacatgatcaagtgggcc

SEQ ID NO: 693723 - DNA, 25 bp, Rattus norvegicus
tttgccttacgtcattgcagatgat

SEQ ID NO: 693724 - DNA, 25 bp, Rattus norvegicus
tttgccttacgtgattgcagatgat

SEQ ID NO: 693725 - DNA, 25 bp, Rattus norvegicus
tttgccttagcccttcggttctgga

SEQ ID NO: 693726 - DNA, 25 bp, Rattus norvegicus
tttgccttagccgttcggttctgga

SEQ ID NO: 693727 - DNA, 25 bp, Rattus norvegicus
tttgccttatgaatgttacttttgc

SEQ ID NO: 693728 - DNA, 25 bp, Rattus norvegicus
tttgccttatgattgttacttttgc

SEQ ID NO: 693729 - DNA, 25 bp, Rattus norvegicus
tttgccttcaaactggtccagattc

SEQ ID NO: 693730 - DNA, 25 bp, Rattus norvegicus
tttgccttcaaagtggtccagattc

SEQ ID NO: 693731 - DNA, 25 bp, Rattus norvegicus
tttgccttcattaccactactagga

SEQ ID NO: 693732 - DNA, 25 bp, Rattus norvegicus
tttgccttcatttccactactagga

SEQ ID NO: 693733 - DNA, 25 bp, Rattus norvegicus
tttgccttcctgaactctgccaggg

SEQ ID NO: 693734 - DNA, 25 bp, Rattus norvegicus
tttgccttcctgtactctgccaggg

SEQ ID NO: 693735 - DNA, 25 bp, Rattus norvegicus
tttgccttgattctgccccattttt

SEQ ID NO: 693736 - DNA, 25 bp, Rattus norvegicus
tttgccttgattgtgccccattttt

SEQ ID NO: 693737 - DNA, 25 bp, Rattus norvegicus
tttgccttgcagcactccaagtgag

SEQ ID NO: 693738 - DNA, 25 bp, Rattus norvegicus
tttgccttgcaggactccaagtgag

SEQ ID NO: 693739 - DNA, 25 bp, Rattus norvegicus
tttgccttgtgtcacagctgtgtga

SEQ ID NO: 693740 - DNA, 25 bp, Rattus norvegicus
tttgccttgtgtgacagctgtgtga

SEQ ID NO: 693741 - DNA, 25 bp, Rattus norvegicus
tttgcctttgatactgcagcactgt

SEQ ID NO: 693742 - DNA, 25 bp, Rattus norvegicus
tttgcctttgattctgcagcactgt

SEQ ID NO: 693743 - DNA, 25 bp, Rattus norvegicus
tttgcctttgccatgagactgtgag

SEQ ID NO: 693744 - DNA, 25 bp, Rattus norvegicus
tttgcctttgccttgagactgtgag

SEQ ID NO: 693745 - DNA, 25 bp, Rattus norvegicus
tttgcctttgttatccctgtcttaa

SEQ ID NO: 693746 - DNA, 25 bp, Rattus norvegicus
tttgcctttgttttccctgtcttaa

SEQ ID NO: 693747 - DNA, 25 bp, Rattus norvegicus
tttgccttttcacgccctttatagt

SEQ ID NO: 693748 - DNA, 25 bp, Rattus norvegicus
tttgccttttcaggccctttatagt

SEQ ID NO: 693749 - DNA, 25 bp, Rattus norvegicus
tttgcgaaatggctctggacccgtg

SEQ ID NO: 693750 - DNA, 25 bp, Rattus norvegicus
tttgcgaaatgggtctggacccgtg

SEQ ID NO: 693751 - DNA, 25 bp, Rattus norvegicus
tttgcgacatgaacctgcgtggctg

SEQ ID NO: 693752 - DNA, 25 bp, Rattus norvegicus
tttgcgacatgatcctgcgtggctg

SEQ ID NO: 693753 - DNA, 25 bp, Rattus norvegicus
tttgcgatcccaattctgtcccaat

SEQ ID NO: 693754 - DNA, 25 bp, Rattus norvegicus
tttgcgatcccatttctgtcccaat

SEQ ID NO: 693755 - DNA, 25 bp, Rattus norvegicus
tttgcgattatccagcatccgaatt

SEQ ID NO: 693756 - DNA, 25 bp, Rattus norvegicus
tttgcgattatcgagcatccgaatt

SEQ ID NO: 693757 - DNA, 25 bp, Rattus norvegicus
tttgcgcaccttcacgaaaaagtat

SEQ ID NO: 693758 - DNA, 25 bp, Rattus norvegicus
tttgcgcaccttgacgaaaaagtat

SEQ ID NO: 693759 - DNA, 25 bp, Rattus norvegicus
tttgcgccagcaccaccgaagaaac

SEQ ID NO: 693760 - DNA, 25 bp, Rattus norvegicus
tttgcgccagcagcaccgaagaaac

SEQ ID NO: 693761 - DNA, 25 bp, Rattus norvegicus
tttgcgcttcgcaactgtagttgca

SEQ ID NO: 693762 - DNA, 25 bp, Rattus norvegicus
tttgcgcttcgctactgtagttgca

SEQ ID NO: 693763 - DNA, 25 bp, Rattus norvegicus
tttgcggacagcagggaagccttca

SEQ ID NO: 693764 - DNA, 25 bp, Rattus norvegicus
tttgcggacagctgggaagccttca

SEQ ID NO: 693765 - DNA, 25 bp, Rattus norvegicus
tttgcggagcttcacccagaccaac

SEQ ID NO: 693766 - DNA, 25 bp, Rattus norvegicus
tttgcggagcttgacccagaccaac

SEQ ID NO: 693767 - DNA, 25 bp, Rattus norvegicus
tttgcggatggccacacagacaacc

SEQ ID NO: 693768 - DNA, 25 bp, Rattus norvegicus
tttgcggatggcgacacagacaacc

SEQ ID NO: 693769 - DNA, 25 bp, Rattus norvegicus
tttgcggcgggcagctctgtacagt

SEQ ID NO: 693770 - DNA, 25 bp, Rattus norvegicus
tttgcggcgggctgctctgtacagt

SEQ ID NO: 693771 - DNA, 25 bp, Rattus norvegicus
tttgcggctcaaatcacagcttcat

SEQ ID NO: 693772 - DNA, 25 bp, Rattus norvegicus
tttgcggctcaattcacagcttcat

SEQ ID NO: 693773 - DNA, 25 bp, Rattus norvegicus
tttgcggctggactctcagggattc

SEQ ID NO: 693774 - DNA, 25 bp, Rattus norvegicus
tttgcggctggagtctcagggattc

SEQ ID NO: 693775 - DNA, 25 bp, Rattus norvegicus
tttgcgggaccacacagcaccctga

SEQ ID NO: 693776 - DNA, 25 bp, Rattus norvegicus
tttgcgggaccagacagcaccctga

SEQ ID NO: 693777 - DNA, 25 bp, Rattus norvegicus
tttgcgggcggcacgctcaggaaac

SEQ ID NO: 693778 - DNA, 25 bp, Rattus norvegicus
tttgcgggcggctcgctcaggaaac

SEQ ID NO: 693779 - DNA, 25 bp, Rattus norvegicus
tttgcggtagttatctctcctcaac

SEQ ID NO: 693780 - DNA, 25 bp, Rattus norvegicus
tttgcggtagttttctctcctcaac

SEQ ID NO: 693781 - DNA, 25 bp, Rattus norvegicus
tttgcggtgaccacgatcctggatg

SEQ ID NO: 693782 - DNA, 25 bp, Rattus norvegicus
tttgcggtgacctcgatcctggatg

SEQ ID NO: 693783 - DNA, 25 bp, Rattus norvegicus
tttgcggtggtgattttctaccatt

SEQ ID NO: 693784 - DNA, 25 bp, Rattus norvegicus
tttgcggtggtgtttttctaccatt

SEQ ID NO: 693785 - DNA, 25 bp, Rattus norvegicus
tttgcggttcacaccataacaactt

SEQ ID NO: 693786 - DNA, 25 bp, Rattus norvegicus
tttgcggttcactccataacaactt

SEQ ID NO: 693787 - DNA, 25 bp, Rattus norvegicus
tttgcggttgttcgtgtgcacatta

SEQ ID NO: 693788 - DNA, 25 bp, Rattus norvegicus
tttgcggttgttggtgtgcacatta

SEQ ID NO: 693789 - DNA, 25 bp, Rattus norvegicus
tttgcgtacaatccgtgtcctctgc

SEQ ID NO: 693790 - DNA, 25 bp, Rattus norvegicus
tttgcgtacaatgcgtgtcctctgc

SEQ ID NO: 693791 - DNA, 25 bp, Rattus norvegicus
tttgcgtcacgccaaagcagcagaa

SEQ ID NO: 693792 - DNA, 25 bp, Rattus norvegicus
tttgcgtcacgcgaaagcagcagaa

SEQ ID NO: 693793 - DNA, 25 bp, Rattus norvegicus
tttgcgtcacttaaagcgtcctgct

SEQ ID NO: 693794 - DNA, 25 bp, Rattus norvegicus
tttgcgtcactttaagcgtcctgct

SEQ ID NO: 693795 - DNA, 25 bp, Rattus norvegicus
tttgcgtgttcgcgactctcccaca

SEQ ID NO: 693796 - DNA, 25 bp, Rattus norvegicus
tttgcgtgttcgggactctcccaca

SEQ ID NO: 693797 - DNA, 25 bp, Rattus norvegicus
tttgcgttagtactatgtccctcag

SEQ ID NO: 693798 - DNA, 25 bp, Rattus norvegicus
tttgcgttagtagtatgtccctcag

SEQ ID NO: 693799 - DNA, 25 bp, Rattus norvegicus
tttgcgttatacctgaaacccaggg

SEQ ID NO: 693800 - DNA, 25 bp, Rattus norvegicus
tttgcgttatacgtgaaacccaggg

SEQ ID NO: 693801 - DNA, 25 bp, Rattus norvegicus
tttgcgttatcaaccttaaaggcct

SEQ ID NO: 693802 - DNA, 25 bp, Rattus norvegicus
tttgcgttatcatccttaaaggcct

SEQ ID NO: 693803 - DNA, 25 bp, Rattus norvegicus
tttgcgttctacactatgacatcat

SEQ ID NO: 693804 - DNA, 25 bp, Rattus norvegicus
tttgcgttctactctatgacatcat

SEQ ID NO: 693805 - DNA, 25 bp, Rattus norvegicus
tttgcgttgcgcatacaatgctgag

SEQ ID NO: 693806 - DNA, 25 bp, Rattus norvegicus
tttgcgttgcgcttacaatgctgag

SEQ ID NO: 693807 - DNA, 25 bp, Rattus norvegicus
tttgcgtttagaacacatgagagcg

SEQ ID NO: 693808 - DNA, 25 bp, Rattus norvegicus
tttgcgtttagatcacatgagagcg

SEQ ID NO: 693809 - DNA, 25 bp, Rattus norvegicus
tttgctaaaggcagctccccaaggg

SEQ ID NO: 693810 - DNA, 25 bp, Rattus norvegicus
tttgctaaaggctgctccccaaggg

SEQ ID NO: 693811 - DNA, 25 bp, Rattus norvegicus
tttgctaacaatcccattaaccgtg

SEQ ID NO: 693812 - DNA, 25 bp, Rattus norvegicus
tttgctaacaatgccattaaccgtg

SEQ ID NO: 693813 - DNA, 25 bp, Rattus norvegicus
tttgctaagtttatgctgatctcca

SEQ ID NO: 693814 - DNA, 25 bp, Rattus norvegicus
tttgctaagtttttgctgatctcca

SEQ ID NO: 693815 - DNA, 25 bp, Rattus norvegicus
tttgctaatttaacagaaggtccga

SEQ ID NO: 693816 - DNA, 25 bp, Rattus norvegicus
tttgctaatttatcagaaggtccga

SEQ ID NO: 693817 - DNA, 25 bp, Rattus norvegicus
tttgctacacaacaaaaagctgcta

SEQ ID NO: 693818 - DNA, 25 bp, Rattus norvegicus
tttgctacacaagaaaaagctgcta

SEQ ID NO: 693819 - DNA, 25 bp, Rattus norvegicus
tttgctacagatcattgctcttcaa

SEQ ID NO: 693820 - DNA, 25 bp, Rattus norvegicus
tttgctacagatgattgctcttcaa

SEQ ID NO: 693821 - DNA, 25 bp, Rattus norvegicus
tttgctaccaagatggtgcccttag

SEQ ID NO: 693822 - DNA, 25 bp, Rattus norvegicus
tttgctaccaagttggtgcccttag

SEQ ID NO: 693823 - DNA, 25 bp, Rattus norvegicus
tttgctaccacaaccacatgatttg

SEQ ID NO: 693824 - DNA, 25 bp, Rattus norvegicus
tttgctaccacatccacatgatttg

SEQ ID NO: 693825 - DNA, 25 bp, Rattus norvegicus
tttgctaccggaaactcagtgtctg

SEQ ID NO: 693826 - DNA, 25 bp, Rattus norvegicus
tttgctaccggatactcagtgtctg

SEQ ID NO: 693827 - DNA, 25 bp, Rattus norvegicus
tttgctacgagtccacattcctgtt

SEQ ID NO: 693828 - DNA, 25 bp, Rattus norvegicus
tttgctacgagtgcacattcctgtt

SEQ ID NO: 693829 - DNA, 25 bp, Rattus norvegicus
tttgctactaaacttgggtgccact

SEQ ID NO: 693830 - DNA, 25 bp, Rattus norvegicus
tttgctactaaagttgggtgccact

SEQ ID NO: 693831 - DNA, 25 bp, Rattus norvegicus
tttgctactccaatagccttttggg

SEQ ID NO: 693832 - DNA, 25 bp, Rattus norvegicus
tttgctactccattagccttttggg

SEQ ID NO: 693833 - DNA, 25 bp, Rattus norvegicus
tttgctactcttccccttgtgaaaa

SEQ ID NO: 693834 - DNA, 25 bp, Rattus norvegicus
tttgctactcttgcccttgtgaaaa

SEQ ID NO: 693835 - DNA, 25 bp, Rattus norvegicus
tttgctactggcacatccggctcaa

SEQ ID NO: 693836 - DNA, 25 bp, Rattus norvegicus
tttgctactggctcatccggctcaa

SEQ ID NO: 693837 - DNA, 25 bp, Rattus norvegicus
tttgctactgtcatcacaaccatgg

SEQ ID NO: 693838 - DNA, 25 bp, Rattus norvegicus
tttgctactgtcttcacaaccatgg

SEQ ID NO: 693839 - DNA, 25 bp, Rattus norvegicus
tttgctactgttctggaccaaggaa

SEQ ID NO: 693840 - DNA, 25 bp, Rattus norvegicus
tttgctactgttgtggaccaaggaa

SEQ ID NO: 693841 - DNA, 25 bp, Rattus norvegicus
tttgctagcccactcagtggtcaga

SEQ ID NO: 693842 - DNA, 25 bp, Rattus norvegicus
tttgctagcccagtcagtggtcaga

SEQ ID NO: 693843 - DNA, 25 bp, Rattus norvegicus
tttgctagctccctgctaaagtgga

SEQ ID NO: 693844 - DNA, 25 bp, Rattus norvegicus
tttgctagctccgtgctaaagtgga

SEQ ID NO: 693845 - DNA, 25 bp, Rattus norvegicus
tttgctaggtctaggcactggtcta

SEQ ID NO: 693846 - DNA, 25 bp, Rattus norvegicus
tttgctaggtcttggcactggtcta

SEQ ID NO: 693847 - DNA, 25 bp, Rattus norvegicus
tttgctagtatcagatctgctgtgg

SEQ ID NO: 693848 - DNA, 25 bp, Rattus norvegicus
tttgctagtatctgatctgctgtgg

SEQ ID NO: 693849 - DNA, 25 bp, Rattus norvegicus
tttgctagttccaatcttctgagat

SEQ ID NO: 693850 - DNA, 25 bp, Rattus norvegicus
tttgctagttcctatcttctgagat

SEQ ID NO: 693851 - DNA, 25 bp, Rattus norvegicus
tttgctataaacaggaatcttctga

SEQ ID NO: 693852 - DNA, 25 bp, Rattus norvegicus
tttgctataaactggaatcttctga

SEQ ID NO: 693853 - DNA, 25 bp, Rattus norvegicus
tttgctatccaaccatttttgctga

SEQ ID NO: 693854 - DNA, 25 bp, Rattus norvegicus
tttgctatccaagcatttttgctga

SEQ ID NO: 693855 - DNA, 25 bp, Rattus norvegicus
tttgctatccagatgctcacactca

SEQ ID NO: 693856 - DNA, 25 bp, Rattus norvegicus
tttgctatccagttgctcacactca

SEQ ID NO: 693857 - DNA, 25 bp, Rattus norvegicus
tttgctatcctgacgtgccagaaat

SEQ ID NO: 693858 - DNA, 25 bp, Rattus norvegicus
tttgctatcctgtcgtgccagaaat

SEQ ID NO: 693859 - DNA, 25 bp, Rattus norvegicus
tttgctatctctctctgaattctac

SEQ ID NO: 693860 - DNA, 25 bp, Rattus norvegicus
tttgctatctctgtctgaattctac

SEQ ID NO: 693861 - DNA, 25 bp, Rattus norvegicus
tttgctatctgacagcagtggctgc

SEQ ID NO: 693862 - DNA, 25 bp, Rattus norvegicus
tttgctatctgagagcagtggctgc

SEQ ID NO: 693863 - DNA, 25 bp, Rattus norvegicus
tttgctatgacgaacggccgaggtg

SEQ ID NO: 693864 - DNA, 25 bp, Rattus norvegicus
tttgctatgacgtacggccgaggtg

SEQ ID NO: 693865 - DNA, 25 bp, Rattus norvegicus
tttgctatgactagggactgtgccc

SEQ ID NO: 693866 - DNA, 25 bp, Rattus norvegicus
tttgctatgacttgggactgtgccc

SEQ ID NO: 693867 - DNA, 25 bp, Rattus norvegicus
tttgctatgcacctgtccttgacta

SEQ ID NO: 693868 - DNA, 25 bp, Rattus norvegicus
tttgctatgcacgtgtccttgacta

SEQ ID NO: 693869 - DNA, 25 bp, Rattus norvegicus
tttgctatgcgccaccctagaggtc

SEQ ID NO: 693870 - DNA, 25 bp, Rattus norvegicus
tttgctatgcgcgaccctagaggtc

SEQ ID NO: 693871 - DNA, 25 bp, Rattus norvegicus
tttgctattgtgagctttgatacca

SEQ ID NO: 693872 - DNA, 25 bp, Rattus norvegicus
tttgctattgtgtgctttgatacca

SEQ ID NO: 693873 - DNA, 25 bp, Rattus norvegicus
tttgctcaagacaatcaattcctct

SEQ ID NO: 693874 - DNA, 25 bp, Rattus norvegicus
tttgctcaagactatcaattcctct

SEQ ID NO: 693875 - DNA, 25 bp, Rattus norvegicus
tttgctcaagatctgcttccagcta

SEQ ID NO: 693876 - DNA, 25 bp, Rattus norvegicus
tttgctcaagatgtgcttccagcta

SEQ ID NO: 693877 - DNA, 25 bp, Rattus norvegicus
tttgctcacaggcatgtactcctac

SEQ ID NO: 693878 - DNA, 25 bp, Rattus norvegicus
tttgctcacagggatgtactcctac

SEQ ID NO: 693879 - DNA, 25 bp, Rattus norvegicus
tttgctcacatacctcatctcagaa

SEQ ID NO: 693880 - DNA, 25 bp, Rattus norvegicus
tttgctcacatagctcatctcagaa

SEQ ID NO: 693881 - DNA, 25 bp, Rattus norvegicus
tttgctcacctgattgatagtcatt

SEQ ID NO: 693882 - DNA, 25 bp, Rattus norvegicus
tttgctcacctgtttgatagtcatt

SEQ ID NO: 693883 - DNA, 25 bp, Rattus norvegicus
tttgctcacttcctggcaagggcag

SEQ ID NO: 693884 - DNA, 25 bp, Rattus norvegicus
tttgctcacttcgtggcaagggcag

SEQ ID NO: 693885 - DNA, 25 bp, Rattus norvegicus
tttgctcagaagcaggagaacccct

SEQ ID NO: 693886 - DNA, 25 bp, Rattus norvegicus
tttgctcagaaggaggagaacccct

SEQ ID NO: 693887 - DNA, 25 bp, Rattus norvegicus
tttgctcagcaaagactgtcagctt

SEQ ID NO: 693888 - DNA, 25 bp, Rattus norvegicus
tttgctcagcaatgactgtcagctt

SEQ ID NO: 693889 - DNA, 25 bp, Rattus norvegicus
tttgctcagcataacgattggtggt

SEQ ID NO: 693890 - DNA, 25 bp, Rattus norvegicus
tttgctcagcattacgattggtggt

SEQ ID NO: 693891 - DNA, 25 bp, Rattus norvegicus
tttgctcagttgatatatccagtat

SEQ ID NO: 693892 - DNA, 25 bp, Rattus norvegicus
tttgctcagttgttatatccagtat

SEQ ID NO: 693893 - DNA, 25 bp, Rattus norvegicus
tttgctcataatctactgtgcgggt

SEQ ID NO: 693894 - DNA, 25 bp, Rattus norvegicus
tttgctcataatgtactgtgcgggt

SEQ ID NO: 693895 - DNA, 25 bp, Rattus norvegicus
tttgctcatcccatcaagagtttga

SEQ ID NO: 693896 - DNA, 25 bp, Rattus norvegicus
tttgctcatcccttcaagagtttga

SEQ ID NO: 693897 - DNA, 25 bp, Rattus norvegicus
tttgctcatcctaggagctccaaag

SEQ ID NO: 693898 - DNA, 25 bp, Rattus norvegicus
tttgctcatccttggagctccaaag

SEQ ID NO: 693899 - DNA, 25 bp, Rattus norvegicus
tttgctcatcgtcggactggtgaac

SEQ ID NO: 693900 - DNA, 25 bp, Rattus norvegicus
tttgctcatcgtgggactggtgaac

SEQ ID NO: 693901 - DNA, 25 bp, Rattus norvegicus
tttgctcatgcacgtattttagtat

SEQ ID NO: 693902 - DNA, 25 bp, Rattus norvegicus
tttgctcatgcaggtattttagtat

SEQ ID NO: 693903 - DNA, 25 bp, Rattus norvegicus
tttgctcattatccagtcatctgtg

SEQ ID NO: 693904 - DNA, 25 bp, Rattus norvegicus
tttgctcattatgcagtcatctgtg

SEQ ID NO: 693905 - DNA, 25 bp, Rattus norvegicus
tttgctcattgtattgtggtccagt

SEQ ID NO: 693906 - DNA, 25 bp, Rattus norvegicus
tttgctcattgtatttgggttttcg

SEQ ID NO: 693907 - DNA, 25 bp, Rattus norvegicus
tttgctcattgttttgtggtccagt

SEQ ID NO: 693908 - DNA, 25 bp, Rattus norvegicus
tttgctcattgtttttgggttttcg

SEQ ID NO: 693909 - DNA, 25 bp, Rattus norvegicus
tttgctcatttcattacaccttgga

SEQ ID NO: 693910 - DNA, 25 bp, Rattus norvegicus
tttgctcatttctttacaccttgga

SEQ ID NO: 693911 - DNA, 25 bp, Rattus norvegicus
tttgctccaaataaacgccgccgat

SEQ ID NO: 693912 - DNA, 25 bp, Rattus norvegicus
tttgctccaaattaacgccgccgat

SEQ ID NO: 693913 - DNA, 25 bp, Rattus norvegicus
tttgctccaggaagtcatgggctat

SEQ ID NO: 693914 - DNA, 25 bp, Rattus norvegicus
tttgctccaggatgtcatgggctat

SEQ ID NO: 693915 - DNA, 25 bp, Rattus norvegicus
tttgctccagttcaagccattctga

SEQ ID NO: 693916 - DNA, 25 bp, Rattus norvegicus
tttgctccagttgaagccattctga

SEQ ID NO: 693917 - DNA, 25 bp, Rattus norvegicus
tttgctcccaacactgagggcaaaa

SEQ ID NO: 693918 - DNA, 25 bp, Rattus norvegicus
tttgctcccaactctgagggcaaaa

SEQ ID NO: 693919 - DNA, 25 bp, Rattus norvegicus
tttgctcccacaatgtgccagatac

SEQ ID NO: 693920 - DNA, 25 bp, Rattus norvegicus
tttgctcccacacagtttcaacttt

SEQ ID NO: 693921 - DNA, 25 bp, Rattus norvegicus
tttgctcccacagagtttcaacttt

SEQ ID NO: 693922 - DNA, 25 bp, Rattus norvegicus
tttgctcccacattgtgccagatac

SEQ ID NO: 693923 - DNA, 25 bp, Rattus norvegicus
tttgctcccagcaaaggtgggtgcc

SEQ ID NO: 693924 - DNA, 25 bp, Rattus norvegicus
tttgctcccagctaaggtgggtgcc

SEQ ID NO: 693925 - DNA, 25 bp, Rattus norvegicus
tttgctcccattaagaactgttgtc

SEQ ID NO: 693926 - DNA, 25 bp, Rattus norvegicus
tttgctcccatttagaactgttgtc

SEQ ID NO: 693927 - DNA, 25 bp, Rattus norvegicus
tttgctccccatcttgctttaataa

SEQ ID NO: 693928 - DNA, 25 bp, Rattus norvegicus
tttgctccccatgttgctttaataa

SEQ ID NO: 693929 - DNA, 25 bp, Rattus norvegicus
tttgctcccggtaattccaaactgg

SEQ ID NO: 693930 - DNA, 25 bp, Rattus norvegicus
tttgctcccggttattccaaactgg

SEQ ID NO: 693931 - DNA, 25 bp, Rattus norvegicus
tttgctccgaaaaggtcagactttg

SEQ ID NO: 693932 - DNA, 25 bp, Rattus norvegicus
tttgctccgaaatggtcagactttg

SEQ ID NO: 693933 - DNA, 25 bp, Rattus norvegicus
tttgctccgccaacatggactctga

SEQ ID NO: 693934 - DNA, 25 bp, Rattus norvegicus
tttgctccgccatcatggactctga

SEQ ID NO: 693935 - DNA, 25 bp, Rattus norvegicus
tttgctccgcgcactgtgtgagacc

SEQ ID NO: 693936 - DNA, 25 bp, Rattus norvegicus
tttgctccgcgctctgtgtgagacc

SEQ ID NO: 693937 - DNA, 25 bp, Rattus norvegicus
tttgctcctatgaaaaacgcctttg

SEQ ID NO: 693938 - DNA, 25 bp, Rattus norvegicus
tttgctcctatgtaaaacgcctttg

SEQ ID NO: 693939 - DNA, 25 bp, Rattus norvegicus
tttgctcctattaccctttgtgttt

SEQ ID NO: 693940 - DNA, 25 bp, Rattus norvegicus
tttgctcctatttccctttgtgttt

SEQ ID NO: 693941 - DNA, 25 bp, Rattus norvegicus
tttgctcctcaacctacgcatggca

SEQ ID NO: 693942 - DNA, 25 bp, Rattus norvegicus
tttgctcctcaagctacgcatggca

SEQ ID NO: 693943 - DNA, 25 bp, Rattus norvegicus
tttgctcctcagatttgagcccaaa

SEQ ID NO: 693944 - DNA, 25 bp, Rattus norvegicus
tttgctcctcagttttgagcccaaa

SEQ ID NO: 693945 - DNA, 25 bp, Rattus norvegicus
tttgctcctcgcatctgagattctt

SEQ ID NO: 693946 - DNA, 25 bp, Rattus norvegicus
tttgctcctcgcttctgagattctt

SEQ ID NO: 693947 - DNA, 25 bp, Rattus norvegicus
tttgctcctgccctgctgttaaaaa

SEQ ID NO: 693948 - DNA, 25 bp, Rattus norvegicus
tttgctcctgccgtgctgttaaaaa

SEQ ID NO: 693949 - DNA, 25 bp, Rattus norvegicus
tttgctcctgctctaaatttggctt

SEQ ID NO: 693950 - DNA, 25 bp, Rattus norvegicus
tttgctcctgctgtaaatttggctt

SEQ ID NO: 693951 - DNA, 25 bp, Rattus norvegicus
tttgctcctttaccttttcctgtcc

SEQ ID NO: 693952 - DNA, 25 bp, Rattus norvegicus
tttgctcctttagcttttcctgtcc

SEQ ID NO: 693953 - DNA, 25 bp, Rattus norvegicus
tttgctccttttcttgtttgacttg

SEQ ID NO: 693954 - DNA, 25 bp, Rattus norvegicus
tttgctccttttgttgtttgacttg

SEQ ID NO: 693955 - DNA, 25 bp, Rattus norvegicus
tttgctcgccaaccaggaggacagt

SEQ ID NO: 693956 - DNA, 25 bp, Rattus norvegicus
tttgctcgccaagcaggaggacagt

SEQ ID NO: 693957 - DNA, 25 bp, Rattus norvegicus
tttgctcgctctcggaatcccgtgg

SEQ ID NO: 693958 - DNA, 25 bp, Rattus norvegicus
tttgctcgctctgggaatcccgtgg

SEQ ID NO: 693959 - DNA, 25 bp, Rattus norvegicus
tttgctcgctggacaaaactacagt

SEQ ID NO: 693960 - DNA, 25 bp, Rattus norvegicus
tttgctcgctggtcaaaactacagt

SEQ ID NO: 693961 - DNA, 25 bp, Rattus norvegicus
tttgctcgctttagcaccggaagca

SEQ ID NO: 693962 - DNA, 25 bp, Rattus norvegicus
tttgctcgcttttgcaccggaagca

SEQ ID NO: 693963 - DNA, 25 bp, Rattus norvegicus
tttgctcggtgaagccaacgagcct

SEQ ID NO: 693964 - DNA, 25 bp, Rattus norvegicus
tttgctcggtgatgccaacgagcct

SEQ ID NO: 693965 - DNA, 25 bp, Rattus norvegicus
tttgctctattcctgtgtgtcctgt

SEQ ID NO: 693966 - DNA, 25 bp, Rattus norvegicus
tttgctctattcgtgtgtgtcctgt

SEQ ID NO: 693967 - DNA, 25 bp, Rattus norvegicus
tttgctctattgagacctggactta

SEQ ID NO: 693968 - DNA, 25 bp, Rattus norvegicus
tttgctctattgtgacctggactta

SEQ ID NO: 693969 - DNA, 25 bp, Rattus norvegicus
tttgctctcagtctctttgtgacac

SEQ ID NO: 693970 - DNA, 25 bp, Rattus norvegicus
tttgctctcagtgtctttgtgacac

SEQ ID NO: 693971 - DNA, 25 bp, Rattus norvegicus
tttgctctcatacctctgctcttga

SEQ ID NO: 693972 - DNA, 25 bp, Rattus norvegicus
tttgctctcatagctctgctcttga

SEQ ID NO: 693973 - DNA, 25 bp, Rattus norvegicus
tttgctctcatcacctgaccaggat

SEQ ID NO: 693974 - DNA, 25 bp, Rattus norvegicus
tttgctctcatctcctgaccaggat

SEQ ID NO: 693975 - DNA, 25 bp, Rattus norvegicus
tttgctctccagatataggacttgg

SEQ ID NO: 693976 - DNA, 25 bp, Rattus norvegicus
tttgctctccagatgactttttgga

SEQ ID NO: 693977 - DNA, 25 bp, Rattus norvegicus
tttgctctccagcatacacatggct

SEQ ID NO: 693978 - DNA, 25 bp, Rattus norvegicus
tttgctctccaggatacacatggct

SEQ ID NO: 693979 - DNA, 25 bp, Rattus norvegicus
tttgctctccagttataggacttgg

SEQ ID NO: 693980 - DNA, 25 bp, Rattus norvegicus
tttgctctccagttgactttttgga

SEQ ID NO: 693981 - DNA, 25 bp, Rattus norvegicus
tttgctctcctcagcctcagcatgg

SEQ ID NO: 693982 - DNA, 25 bp, Rattus norvegicus
tttgctctcctctgcctcagcatgg

SEQ ID NO: 693983 - DNA, 25 bp, Rattus norvegicus
tttgctctcctgagacctaggaaaa

SEQ ID NO: 693984 - DNA, 25 bp, Rattus norvegicus
tttgctctcctgtgacctaggaaaa

SEQ ID NO: 693985 - DNA, 25 bp, Rattus norvegicus
tttgctctctatcaacctgactaga

SEQ ID NO: 693986 - DNA, 25 bp, Rattus norvegicus
tttgctctctatgaacctgactaga

SEQ ID NO: 693987 - DNA, 25 bp, Rattus norvegicus
tttgctctctccatttgtctgatag

SEQ ID NO: 693988 - DNA, 25 bp, Rattus norvegicus
tttgctctctccttttgtctgatag

SEQ ID NO: 693989 - DNA, 25 bp, Rattus norvegicus
tttgctctcttcactgatgatatta

SEQ ID NO: 693990 - DNA, 25 bp, Rattus norvegicus
tttgctctcttctctgatgatatta

SEQ ID NO: 693991 - DNA, 25 bp, Rattus norvegicus
tttgctctgacgatggaagtgacct

SEQ ID NO: 693992 - DNA, 25 bp, Rattus norvegicus
tttgctctgacgttggaagtgacct

SEQ ID NO: 693993 - DNA, 25 bp, Rattus norvegicus
tttgctctgagtaacccttgaaacg

SEQ ID NO: 693994 - DNA, 25 bp, Rattus norvegicus
tttgctctgagttacccttgaaacg

SEQ ID NO: 693995 - DNA, 25 bp, Rattus norvegicus
tttgctctgattcctgactttttag

SEQ ID NO: 693996 - DNA, 25 bp, Rattus norvegicus
tttgctctgattcttgccaaaatga

SEQ ID NO: 693997 - DNA, 25 bp, Rattus norvegicus
tttgctctgattgctgactttttag

SEQ ID NO: 693998 - DNA, 25 bp, Rattus norvegicus
tttgctctgattgttgccaaaatga

SEQ ID NO: 693999 - DNA, 25 bp, Rattus norvegicus
tttgctctgccccaggccagctggg

SEQ ID NO: 694000 - DNA, 25 bp, Rattus norvegicus
tttgctctgcccgaggccagctggg

SEQ ID NO: 694001 - DNA, 25 bp, Rattus norvegicus
tttgctctgccgaatgttttccaca

SEQ ID NO: 694002 - DNA, 25 bp, Rattus norvegicus
tttgctctgccgtatgttttccaca

SEQ ID NO: 694003 - DNA, 25 bp, Rattus norvegicus
tttgctcttactatctttatcatga

SEQ ID NO: 694004 - DNA, 25 bp, Rattus norvegicus
tttgctcttactttctttatcatga

SEQ ID NO: 694005 - DNA, 25 bp, Rattus norvegicus
tttgctcttcctagacttatgacgc

SEQ ID NO: 694006 - DNA, 25 bp, Rattus norvegicus
tttgctcttccttgacttatgacgc

SEQ ID NO: 694007 - DNA, 25 bp, Rattus norvegicus
tttgctcttctgaatgtgacaacat

SEQ ID NO: 694008 - DNA, 25 bp, Rattus norvegicus
tttgctcttctgtatgtgacaacat

SEQ ID NO: 694009 - DNA, 25 bp, Rattus norvegicus
tttgctcttgggaagaatttcctca

SEQ ID NO: 694010 - DNA, 25 bp, Rattus norvegicus
tttgctcttgggtagaatttcctca

SEQ ID NO: 694011 - DNA, 25 bp, Rattus norvegicus
tttgctctttgcattgaaaaccgtt

SEQ ID NO: 694012 - DNA, 25 bp, Rattus norvegicus
tttgctctttgctttgaaaaccgtt

SEQ ID NO: 694013 - DNA, 25 bp, Rattus norvegicus
tttgctgaaacccatctacctggtg

SEQ ID NO: 694014 - DNA, 25 bp, Rattus norvegicus
tttgctgaaaccgatctacctggtg

SEQ ID NO: 694015 - DNA, 25 bp, Rattus norvegicus
tttgctgaaagtactcacactgtga

SEQ ID NO: 694016 - DNA, 25 bp, Rattus norvegicus
tttgctgaaagttctcacactgtga

SEQ ID NO: 694017 - DNA, 25 bp, Rattus norvegicus
tttgctgaacaacaacactgctatc

SEQ ID NO: 694018 - DNA, 25 bp, Rattus norvegicus
tttgctgaacaagaacactgctatc

SEQ ID NO: 694019 - DNA, 25 bp, Rattus norvegicus
tttgctgacaacacctttctgtgca

SEQ ID NO: 694020 - DNA, 25 bp, Rattus norvegicus
tttgctgacaactcctttctgtgca

SEQ ID NO: 694021 - DNA, 25 bp, Rattus norvegicus
tttgctgacaatcagctcctgctac

SEQ ID NO: 694022 - DNA, 25 bp, Rattus norvegicus
tttgctgacaatgagctcctgctac

SEQ ID NO: 694023 - DNA, 25 bp, Rattus norvegicus
tttgctgactacaactcatcttttg

SEQ ID NO: 694024 - DNA, 25 bp, Rattus norvegicus
tttgctgactactactcatcttttg

SEQ ID NO: 694025 - DNA, 25 bp, Rattus norvegicus
tttgctgagaggaactgtccatgag

SEQ ID NO: 694026 - DNA, 25 bp, Rattus norvegicus
tttgctgagaggtactgtccatgag

SEQ ID NO: 694027 - DNA, 25 bp, Rattus norvegicus
tttgctgagctaataactggactgt

SEQ ID NO: 694028 - DNA, 25 bp, Rattus norvegicus
tttgctgagctattaactggactgt

SEQ ID NO: 694029 - DNA, 25 bp, Rattus norvegicus
tttgctgaggcacacgacccttctt

SEQ ID NO: 694030 - DNA, 25 bp, Rattus norvegicus
tttgctgaggcagacgacccttctt

SEQ ID NO: 694031 - DNA, 25 bp, Rattus norvegicus
tttgctgatacaccagtgaccctac

SEQ ID NO: 694032 - DNA, 25 bp, Rattus norvegicus
tttgctgatacagcagtgaccctac

SEQ ID NO: 694033 - DNA, 25 bp, Rattus norvegicus
tttgctgatagtcgatcctaccggg

SEQ ID NO: 694034 - DNA, 25 bp, Rattus norvegicus
tttgctgatagtggatcctaccggg

SEQ ID NO: 694035 - DNA, 25 bp, Rattus norvegicus
tttgctgatcttattctctaacccc

SEQ ID NO: 694036 - DNA, 25 bp, Rattus norvegicus
tttgctgatctttttctctaacccc

SEQ ID NO: 694037 - DNA, 25 bp, Rattus norvegicus
tttgctgcacagaaaatggaccatt

SEQ ID NO: 694038 - DNA, 25 bp, Rattus norvegicus
tttgctgcacagtaaatggaccatt

SEQ ID NO: 694039 - DNA, 25 bp, Rattus norvegicus
tttgctgcatgcaagaactgtactt

SEQ ID NO: 694040 - DNA, 25 bp, Rattus norvegicus
tttgctgcatgctagaactgtactt

SEQ ID NO: 694041 - DNA, 25 bp, Rattus norvegicus
tttgctgccagcactgatgacctga

SEQ ID NO: 694042 - DNA, 25 bp, Rattus norvegicus
tttgctgccagcctctacttataga

SEQ ID NO: 694043 - DNA, 25 bp, Rattus norvegicus
tttgctgccagcgtctacttataga

SEQ ID NO: 694044 - DNA, 25 bp, Rattus norvegicus
tttgctgccagctctgatgacctga

SEQ ID NO: 694045 - DNA, 25 bp, Rattus norvegicus
tttgctgccagtcaagggcactctc

SEQ ID NO: 694046 - DNA, 25 bp, Rattus norvegicus
tttgctgccagtcagtttcttgcac

SEQ ID NO: 694047 - DNA, 25 bp, Rattus norvegicus
tttgctgccagtctaatctctgcaa

SEQ ID NO: 694048 - DNA, 25 bp, Rattus norvegicus
tttgctgccagtgaagggcactctc

SEQ ID NO: 694049 - DNA, 25 bp, Rattus norvegicus
tttgctgccagtgagtttcttgcac

SEQ ID NO: 694050 - DNA, 25 bp, Rattus norvegicus
tttgctgccagtgtaatctctgcaa

SEQ ID NO: 694051 - DNA, 25 bp, Rattus norvegicus
tttgctgccccgcaagtgatccaag

SEQ ID NO: 694052 - DNA, 25 bp, Rattus norvegicus
tttgctgccccggaagtgatccaag

SEQ ID NO: 694053 - DNA, 25 bp, Rattus norvegicus
tttgctgccctgactgttcgtccca

SEQ ID NO: 694054 - DNA, 25 bp, Rattus norvegicus
tttgctgccctgctggagtatgcat

SEQ ID NO: 694055 - DNA, 25 bp, Rattus norvegicus
tttgctgccctggtggagtatgcat

SEQ ID NO: 694056 - DNA, 25 bp, Rattus norvegicus
tttgctgccctgtctgttcgtccca

SEQ ID NO: 694057 - DNA, 25 bp, Rattus norvegicus
tttgctgctgcaactgacgagtcgt

SEQ ID NO: 694058 - DNA, 25 bp, Rattus norvegicus
tttgctgctgcatctgacgagtcgt

SEQ ID NO: 694059 - DNA, 25 bp, Rattus norvegicus
tttgctggactcactctctctttgg

SEQ ID NO: 694060 - DNA, 25 bp, Rattus norvegicus
tttgctggactctctctctctttgg

SEQ ID NO: 694061 - DNA, 25 bp, Rattus norvegicus
tttgctggcaatctgcaggctggta

SEQ ID NO: 694062 - DNA, 25 bp, Rattus norvegicus
tttgctggcaatgtgcaggctggta

SEQ ID NO: 694063 - DNA, 25 bp, Rattus norvegicus
tttgctggccataagcagccaacct

SEQ ID NO: 694064 - DNA, 25 bp, Rattus norvegicus
tttgctggccattagcagccaacct

SEQ ID NO: 694065 - DNA, 25 bp, Rattus norvegicus
tttgctggccccctgaggaaaaggc

SEQ ID NO: 694066 - DNA, 25 bp, Rattus norvegicus
tttgctggccccgtgaggaaaaggc

SEQ ID NO: 694067 - DNA, 25 bp, Rattus norvegicus
tttgctggcgttctttaacccgaag

SEQ ID NO: 694068 - DNA, 25 bp, Rattus norvegicus
tttgctggcgttgtttaacccgaag

SEQ ID NO: 694069 - DNA, 25 bp, Rattus norvegicus
tttgctgggaatatggtgccctcga

SEQ ID NO: 694070 - DNA, 25 bp, Rattus norvegicus
tttgctgggaatttggtgccctcga

SEQ ID NO: 694071 - DNA, 25 bp, Rattus norvegicus
tttgctgggagcagggatagtaaaa

SEQ ID NO: 694072 - DNA, 25 bp, Rattus norvegicus
tttgctgggagctgggatagtaaaa

SEQ ID NO: 694073 - DNA, 25 bp, Rattus norvegicus
tttgctgggcttataatgttatctc

SEQ ID NO: 694074 - DNA, 25 bp, Rattus norvegicus
tttgctgggcttttaatgttatctc

SEQ ID NO: 694075 - DNA, 25 bp, Rattus norvegicus
tttgctggtaacacacagtgacttg

SEQ ID NO: 694076 - DNA, 25 bp, Rattus norvegicus
tttgctggtaactcacagtgacttg

SEQ ID NO: 694077 - DNA, 25 bp, Rattus norvegicus
tttgctggtccgctagaggtgaatc

SEQ ID NO: 694078 - DNA, 25 bp, Rattus norvegicus
tttgctggtccggtagaggtgaatc

SEQ ID NO: 694079 - DNA, 25 bp, Rattus norvegicus
tttgctggtgatcaggaaacctcca

SEQ ID NO: 694080 - DNA, 25 bp, Rattus norvegicus
tttgctggtgatgaggaaacctcca

SEQ ID NO: 694081 - DNA, 25 bp, Rattus norvegicus
tttgctggtttactctaggacttca

SEQ ID NO: 694082 - DNA, 25 bp, Rattus norvegicus
tttgctggtttagtctaggacttca

SEQ ID NO: 694083 - DNA, 25 bp, Rattus norvegicus
tttgctggtttcctatacgcttgct

SEQ ID NO: 694084 - DNA, 25 bp, Rattus norvegicus
tttgctggtttcgtatacgcttgct

SEQ ID NO: 694085 - DNA, 25 bp, Rattus norvegicus
tttgctgtaaagattctcccactac

SEQ ID NO: 694086 - DNA, 25 bp, Rattus norvegicus
tttgctgtaaagtttctcccactac

SEQ ID NO: 694087 - DNA, 25 bp, Rattus norvegicus
tttgctgtaatcattcccaacttct

SEQ ID NO: 694088 - DNA, 25 bp, Rattus norvegicus
tttgctgtaatctttcccaacttct

SEQ ID NO: 694089 - DNA, 25 bp, Rattus norvegicus
tttgctgtaccacccaaaagttgta

SEQ ID NO: 694090 - DNA, 25 bp, Rattus norvegicus
tttgctgtaccagccaaaagttgta

SEQ ID NO: 694091 - DNA, 25 bp, Rattus norvegicus
tttgctgtacccataatcggatcaa

SEQ ID NO: 694092 - DNA, 25 bp, Rattus norvegicus
tttgctgtacccttaatcggatcaa

SEQ ID NO: 694093 - DNA, 25 bp, Rattus norvegicus
tttgctgtagatcccattcagggct

SEQ ID NO: 694094 - DNA, 25 bp, Rattus norvegicus
tttgctgtagatgccattcagggct

SEQ ID NO: 694095 - DNA, 25 bp, Rattus norvegicus
tttgctgtagctcaattgccaacat

SEQ ID NO: 694096 - DNA, 25 bp, Rattus norvegicus
tttgctgtagctgaattgccaacat

SEQ ID NO: 694097 - DNA, 25 bp, Rattus norvegicus
tttgctgtcagccagtacaatgaaa

SEQ ID NO: 694098 - DNA, 25 bp, Rattus norvegicus
tttgctgtcagcgagtacaatgaaa

SEQ ID NO: 694099 - DNA, 25 bp, Rattus norvegicus
tttgctgtcattcatctgcaccgat

SEQ ID NO: 694100 - DNA, 25 bp, Rattus norvegicus
tttgctgtcattgatctgcaccgat

SEQ ID NO: 694101 - DNA, 25 bp, Rattus norvegicus
tttgctgtcgtcaaagtcttgctgt

SEQ ID NO: 694102 - DNA, 25 bp, Rattus norvegicus
tttgctgtcgtctaagtcttgctgt

SEQ ID NO: 694103 - DNA, 25 bp, Rattus norvegicus
tttgctgtctcgcaaaaggaactat

SEQ ID NO: 694104 - DNA, 25 bp, Rattus norvegicus
tttgctgtctcggaaaaggaactat

SEQ ID NO: 694105 - DNA, 25 bp, Rattus norvegicus
tttgctgtgaacagcagaccttcgc

SEQ ID NO: 694106 - DNA, 25 bp, Rattus norvegicus
tttgctgtgaactgcagaccttcgc

SEQ ID NO: 694107 - DNA, 25 bp, Rattus norvegicus
tttgctgtgaccataccggtttgaa

SEQ ID NO: 694108 - DNA, 25 bp, Rattus norvegicus
tttgctgtgaccttaccggtttgaa

SEQ ID NO: 694109 - DNA, 25 bp, Rattus norvegicus
tttgctgtgaggcagacttacttat

SEQ ID NO: 694110 - DNA, 25 bp, Rattus norvegicus
tttgctgtgagggagacttacttat

SEQ ID NO: 694111 - DNA, 25 bp, Rattus norvegicus
tttgctgtgctgagcccgattcatg

SEQ ID NO: 694112 - DNA, 25 bp, Rattus norvegicus
tttgctgtgctgtgcccgattcatg

SEQ ID NO: 694113 - DNA, 25 bp, Rattus norvegicus
tttgctgtggtaatgctttaagtct

SEQ ID NO: 694114 - DNA, 25 bp, Rattus norvegicus
tttgctgtggtattgctttaagtct

SEQ ID NO: 694115 - DNA, 25 bp, Rattus norvegicus
tttgctgtggtccatctttgatgcc

SEQ ID NO: 694116 - DNA, 25 bp, Rattus norvegicus
tttgctgtggtcgatctttgatgcc

SEQ ID NO: 694117 - DNA, 25 bp, Rattus norvegicus
tttgctgtgtgcagtatgtgcgttt

SEQ ID NO: 694118 - DNA, 25 bp, Rattus norvegicus
tttgctgtgtgctgtatgtgcgttt

SEQ ID NO: 694119 - DNA, 25 bp, Rattus norvegicus
tttgctgtgtgtacactcgggattt

SEQ ID NO: 694120 - DNA, 25 bp, Rattus norvegicus
tttgctgtgtgttcactcgggattt

SEQ ID NO: 694121 - DNA, 25 bp, Rattus norvegicus
tttgctgtgttcaggatgcaggcat

SEQ ID NO: 694122 - DNA, 25 bp, Rattus norvegicus
tttgctgtgttctggatgcaggcat

SEQ ID NO: 694123 - DNA, 25 bp, Rattus norvegicus
tttgctgttatcaagatggtgcctg

SEQ ID NO: 694124 - DNA, 25 bp, Rattus norvegicus
tttgctgttatctagatggtgcctg

SEQ ID NO: 694125 - DNA, 25 bp, Rattus norvegicus
tttgctgttctcaggtagctggaaa

SEQ ID NO: 694126 - DNA, 25 bp, Rattus norvegicus
tttgctgttctctggtagctggaaa

SEQ ID NO: 694127 - DNA, 25 bp, Rattus norvegicus
tttgctgttgacctgaccgtggaac

SEQ ID NO: 694128 - DNA, 25 bp, Rattus norvegicus
tttgctgttgacgtgaccgtggaac

SEQ ID NO: 694129 - DNA, 25 bp, Rattus norvegicus
tttgctgtttaaatggttccaccct

SEQ ID NO: 694130 - DNA, 25 bp, Rattus norvegicus
tttgctgtttaattggttccaccct

SEQ ID NO: 694131 - DNA, 25 bp, Rattus norvegicus
tttgctgtttctactccagtgagga

SEQ ID NO: 694132 - DNA, 25 bp, Rattus norvegicus
tttgctgtttcttctccagtgagga

SEQ ID NO: 694133 - DNA, 25 bp, Rattus norvegicus
tttgctgtttgaacttttgggccct

SEQ ID NO: 694134 - DNA, 25 bp, Rattus norvegicus
tttgctgtttgatcttttgggccct

SEQ ID NO: 694135 - DNA, 25 bp, Rattus norvegicus
tttgctgtttgcagcgggctggatt

SEQ ID NO: 694136 - DNA, 25 bp, Rattus norvegicus
tttgctgtttgctgcgggctggatt

SEQ ID NO: 694137 - DNA, 25 bp, Rattus norvegicus
tttgctgttttcaagacctttccct

SEQ ID NO: 694138 - DNA, 25 bp, Rattus norvegicus
tttgctgttttctagacctttccct

SEQ ID NO: 694139 - DNA, 25 bp, Rattus norvegicus
tttgctgtttttctctactggcttg

SEQ ID NO: 694140 - DNA, 25 bp, Rattus norvegicus
tttgctgtttttgtctactggcttg

SEQ ID NO: 694141 - DNA, 25 bp, Rattus norvegicus
tttgcttaaattagatatgcctggc

SEQ ID NO: 694142 - DNA, 25 bp, Rattus norvegicus
tttgcttaaatttgatatgcctggc

SEQ ID NO: 694143 - DNA, 25 bp, Rattus norvegicus
tttgcttaacacatttgctaagtaa

SEQ ID NO: 694144 - DNA, 25 bp, Rattus norvegicus
tttgcttaacacttttgctaagtaa

SEQ ID NO: 694145 - DNA, 25 bp, Rattus norvegicus
tttgcttacccgacatctaagttgt

SEQ ID NO: 694146 - DNA, 25 bp, Rattus norvegicus
tttgcttacccgtcatctaagttgt

SEQ ID NO: 694147 - DNA, 25 bp, Rattus norvegicus
tttgcttagaacactgatgaacggt

SEQ ID NO: 694148 - DNA, 25 bp, Rattus norvegicus
tttgcttagaactctgatgaacggt

SEQ ID NO: 694149 - DNA, 25 bp, Rattus norvegicus
tttgcttatatactatctcccttcg

SEQ ID NO: 694150 - DNA, 25 bp, Rattus norvegicus
tttgcttatatagtatctcccttcg

SEQ ID NO: 694151 - DNA, 25 bp, Rattus norvegicus
tttgcttatccaagtccaggaagga

SEQ ID NO: 694152 - DNA, 25 bp, Rattus norvegicus
tttgcttatccatgtccaggaagga

SEQ ID NO: 694153 - DNA, 25 bp, Rattus norvegicus
tttgcttatgcaatccacttaaggg

SEQ ID NO: 694154 - DNA, 25 bp, Rattus norvegicus
tttgcttatgcattccacttaaggg

SEQ ID NO: 694155 - DNA, 25 bp, Rattus norvegicus
tttgcttcacttctctccgagatgg

SEQ ID NO: 694156 - DNA, 25 bp, Rattus norvegicus
tttgcttcacttgtctccgagatgg

SEQ ID NO: 694157 - DNA, 25 bp, Rattus norvegicus
tttgcttcagcaacaccgatgtggg

SEQ ID NO: 694158 - DNA, 25 bp, Rattus norvegicus
tttgcttcagcatcaccgatgtggg

SEQ ID NO: 694159 - DNA, 25 bp, Rattus norvegicus
tttgcttcccaacccggatggagac

SEQ ID NO: 694160 - DNA, 25 bp, Rattus norvegicus
tttgcttcccaagccggatggagac

SEQ ID NO: 694161 - DNA, 25 bp, Rattus norvegicus
tttgcttcctaactgctgtgtgtct

SEQ ID NO: 694162 - DNA, 25 bp, Rattus norvegicus
tttgcttcctaagtgctgtgtgtct

SEQ ID NO: 694163 - DNA, 25 bp, Rattus norvegicus
tttgcttcctctatctttgggagcc

SEQ ID NO: 694164 - DNA, 25 bp, Rattus norvegicus
tttgcttcctctttctttgggagcc

SEQ ID NO: 694165 - DNA, 25 bp, Rattus norvegicus
tttgcttcctggacatttccctaaa

SEQ ID NO: 694166 - DNA, 25 bp, Rattus norvegicus
tttgcttcctggacctcgaacaatc

SEQ ID NO: 694167 - DNA, 25 bp, Rattus norvegicus
tttgcttcctggtcatttccctaaa

SEQ ID NO: 694168 - DNA, 25 bp, Rattus norvegicus
tttgcttcctggtcctcgaacaatc

SEQ ID NO: 694169 - DNA, 25 bp, Rattus norvegicus
tttgcttccttgctgctgtgataac

SEQ ID NO: 694170 - DNA, 25 bp, Rattus norvegicus
tttgcttccttggtgctgtgataac

SEQ ID NO: 694171 - DNA, 25 bp, Rattus norvegicus
tttgcttctaccagtatatcttcag

SEQ ID NO: 694172 - DNA, 25 bp, Rattus norvegicus
tttgcttctacctgtatatcttcag

SEQ ID NO: 694173 - DNA, 25 bp, Rattus norvegicus
tttgcttctgaacgccgtcattaga

SEQ ID NO: 694174 - DNA, 25 bp, Rattus norvegicus
tttgcttctgaaggccgtcattaga

SEQ ID NO: 694175 - DNA, 25 bp, Rattus norvegicus
tttgcttctgtaccccaagtagaga

SEQ ID NO: 694176 - DNA, 25 bp, Rattus norvegicus
tttgcttctgtagcccaagtagaga

SEQ ID NO: 694177 - DNA, 25 bp, Rattus norvegicus
tttgcttctgtgagagcctacaaca

SEQ ID NO: 694178 - DNA, 25 bp, Rattus norvegicus
tttgcttctgtgtgagcctacaaca

SEQ ID NO: 694179 - DNA, 25 bp, Rattus norvegicus
tttgcttctgttattcatcctgtgt

SEQ ID NO: 694180 - DNA, 25 bp, Rattus norvegicus
tttgcttctgtttttcatcctgtgt

SEQ ID NO: 694181 - DNA, 25 bp, Rattus norvegicus
tttgcttcttccctaacatgtgata

SEQ ID NO: 694182 - DNA, 25 bp, Rattus norvegicus
tttgcttcttccgtaacatgtgata

SEQ ID NO: 694183 - DNA, 25 bp, Rattus norvegicus
tttgcttgatttcgcttggtttttc

SEQ ID NO: 694184 - DNA, 25 bp, Rattus norvegicus
tttgcttgatttggcttggtttttc

SEQ ID NO: 694185 - DNA, 25 bp, Rattus norvegicus
tttgcttgcactaacgatcccgaag

SEQ ID NO: 694186 - DNA, 25 bp, Rattus norvegicus
tttgcttgcacttacgatcccgaag

SEQ ID NO: 694187 - DNA, 25 bp, Rattus norvegicus
tttgcttgcaggaacaatactacag

SEQ ID NO: 694188 - DNA, 25 bp, Rattus norvegicus
tttgcttgcaggtacaatactacag

SEQ ID NO: 694189 - DNA, 25 bp, Rattus norvegicus
tttgcttgccctaggtctgacataa

SEQ ID NO: 694190 - DNA, 25 bp, Rattus norvegicus
tttgcttgcccttggtctgacataa

SEQ ID NO: 694191 - DNA, 25 bp, Rattus norvegicus
tttgcttgggaccacagtgctcaca

SEQ ID NO: 694192 - DNA, 25 bp, Rattus norvegicus
tttgcttgggacgacagtgctcaca

SEQ ID NO: 694193 - DNA, 25 bp, Rattus norvegicus
tttgcttgtgtgagaacctatcccc

SEQ ID NO: 694194 - DNA, 25 bp, Rattus norvegicus
tttgcttgtgtgtgaacctatcccc

SEQ ID NO: 694195 - DNA, 25 bp, Rattus norvegicus
tttgcttgttacaacacacacatgc

SEQ ID NO: 694196 - DNA, 25 bp, Rattus norvegicus
tttgcttgttactacacacacatgc

SEQ ID NO: 694197 - DNA, 25 bp, Rattus norvegicus
tttgctttacccatgtgtttattat

SEQ ID NO: 694198 - DNA, 25 bp, Rattus norvegicus
tttgctttacccttgtgtttattat

SEQ ID NO: 694199 - DNA, 25 bp, Rattus norvegicus
tttgctttatgactggctacaacgt

SEQ ID NO: 694200 - DNA, 25 bp, Rattus norvegicus
tttgctttatgagtggctacaacgt

SEQ ID NO: 694201 - DNA, 25 bp, Rattus norvegicus
tttgctttcaggcttcctatatgag

SEQ ID NO: 694202 - DNA, 25 bp, Rattus norvegicus
tttgctttcagggttcctatatgag

SEQ ID NO: 694203 - DNA, 25 bp, Rattus norvegicus
tttgctttcataagtgtccctgcta

SEQ ID NO: 694204 - DNA, 25 bp, Rattus norvegicus
tttgctttcatatgtgtccctgcta

SEQ ID NO: 694205 - DNA, 25 bp, Rattus norvegicus
tttgctttccaaatgtcttgtggtt

SEQ ID NO: 694206 - DNA, 25 bp, Rattus norvegicus
tttgctttccaattgtcttgtggtt

SEQ ID NO: 694207 - DNA, 25 bp, Rattus norvegicus
tttgctttccggacacaaaccaaat

SEQ ID NO: 694208 - DNA, 25 bp, Rattus norvegicus
tttgctttccggtcacaaaccaaat

SEQ ID NO: 694209 - DNA, 25 bp, Rattus norvegicus
tttgctttcgggagtcagagcgttt

SEQ ID NO: 694210 - DNA, 25 bp, Rattus norvegicus
tttgctttcgggtgtcagagcgttt

SEQ ID NO: 694211 - DNA, 25 bp, Rattus norvegicus
tttgctttcgtcctcttctgctcaa

SEQ ID NO: 694212 - DNA, 25 bp, Rattus norvegicus
tttgctttcgtcgtcttctgctcaa

SEQ ID NO: 694213 - DNA, 25 bp, Rattus norvegicus
tttgctttctctcccaattaaagaa

SEQ ID NO: 694214 - DNA, 25 bp, Rattus norvegicus
tttgctttctctgccaattaaagaa

SEQ ID NO: 694215 - DNA, 25 bp, Rattus norvegicus
tttgctttgaggctctccagggtaa

SEQ ID NO: 694216 - DNA, 25 bp, Rattus norvegicus
tttgctttgagggtctccagggtaa

SEQ ID NO: 694217 - DNA, 25 bp, Rattus norvegicus
tttgctttgcttcaggtagtccact

SEQ ID NO: 694218 - DNA, 25 bp, Rattus norvegicus
tttgctttgcttgaggtagtccact

SEQ ID NO: 694219 - DNA, 25 bp, Rattus norvegicus
tttgctttggcaactatgactgtgt

SEQ ID NO: 694220 - DNA, 25 bp, Rattus norvegicus
tttgctttggcatctatgactgtgt

SEQ ID NO: 694221 - DNA, 25 bp, Rattus norvegicus
tttgctttgggcacatggtagtaca

SEQ ID NO: 694222 - DNA, 25 bp, Rattus norvegicus
tttgctttgggctcatggtagtaca

SEQ ID NO: 694223 - DNA, 25 bp, Rattus norvegicus
tttgctttggttacaatggctcaag

SEQ ID NO: 694224 - DNA, 25 bp, Rattus norvegicus
tttgctttggtttcaatggctcaag

SEQ ID NO: 694225 - DNA, 25 bp, Rattus norvegicus
tttgctttgtccaaactctcttagc

SEQ ID NO: 694226 - DNA, 25 bp, Rattus norvegicus
tttgctttgtcctaactctcttagc

SEQ ID NO: 694227 - DNA, 25 bp, Rattus norvegicus
tttgcttttcacctttgtctgtgag

SEQ ID NO: 694228 - DNA, 25 bp, Rattus norvegicus
tttgcttttcacgtttgtctgtgag

SEQ ID NO: 694229 - DNA, 25 bp, Rattus norvegicus
tttgcttttctcagcgcttcagaaa

SEQ ID NO: 694230 - DNA, 25 bp, Rattus norvegicus
tttgcttttctctgcgcttcagaaa

SEQ ID NO: 694231 - DNA, 25 bp, Rattus norvegicus
tttgcttttgacataaggctgctct

SEQ ID NO: 694232 - DNA, 25 bp, Rattus norvegicus
tttgcttttgacttaaggctgctct

SEQ ID NO: 694233 - DNA, 25 bp, Rattus norvegicus
tttgcttttgcacggagaacactag

SEQ ID NO: 694234 - DNA, 25 bp, Rattus norvegicus
tttgcttttgcagggagaacactag

SEQ ID NO: 694235 - DNA, 25 bp, Rattus norvegicus
tttgcttttgctacttcgagacctc

SEQ ID NO: 694236 - DNA, 25 bp, Rattus norvegicus
tttgcttttgctattattccttgta

SEQ ID NO: 694237 - DNA, 25 bp, Rattus norvegicus
tttgcttttgcttcttcgagacctc

SEQ ID NO: 694238 - DNA, 25 bp, Rattus norvegicus
tttgcttttgcttttattccttgta

SEQ ID NO: 694239 - DNA, 25 bp, Rattus norvegicus
tttgctttttgaatcgaagacccga

SEQ ID NO: 694240 - DNA, 25 bp, Rattus norvegicus
tttgctttttgattcgaagacccga

SEQ ID NO: 694241 - DNA, 25 bp, Rattus norvegicus
tttggaaaaaccaacagcccggatg

SEQ ID NO: 694242 - DNA, 25 bp, Rattus norvegicus
tttggaaaaacctacagcccggatg

SEQ ID NO: 694243 - DNA, 25 bp, Rattus norvegicus
tttggaaaaggaacccagccactgg

SEQ ID NO: 694244 - DNA, 25 bp, Rattus norvegicus
tttggaaaaggatcccagccactgg

SEQ ID NO: 694245 - DNA, 25 bp, Rattus norvegicus
tttggaaaaggccaatgcccaattc

SEQ ID NO: 694246 - DNA, 25 bp, Rattus norvegicus
tttggaaaaggcgaatgcccaattc

SEQ ID NO: 694247 - DNA, 25 bp, Rattus norvegicus
tttggaaacctgaatcacaccttaa

SEQ ID NO: 694248 - DNA, 25 bp, Rattus norvegicus
tttggaaacctgtatcacaccttaa

SEQ ID NO: 694249 - DNA, 25 bp, Rattus norvegicus
tttggaaagcacatcagattttact

SEQ ID NO: 694250 - DNA, 25 bp, Rattus norvegicus
tttggaaagcacttcagattttact

SEQ ID NO: 694251 - DNA, 25 bp, Rattus norvegicus
tttggaaagcccaccgtgttatgag

SEQ ID NO: 694252 - DNA, 25 bp, Rattus norvegicus
tttggaaagccctccgtgttatgag

SEQ ID NO: 694253 - DNA, 25 bp, Rattus norvegicus
tttggaaagcctcccctacagagtg

SEQ ID NO: 694254 - DNA, 25 bp, Rattus norvegicus
tttggaaagcctgccctacagagtg

SEQ ID NO: 694255 - DNA, 25 bp, Rattus norvegicus
tttggaaagctgacacatgtcccca

SEQ ID NO: 694256 - DNA, 25 bp, Rattus norvegicus
tttggaaagctgtcacatgtcccca

SEQ ID NO: 694257 - DNA, 25 bp, Rattus norvegicus
tttggaaatcaaagcctgggtttgc

SEQ ID NO: 694258 - DNA, 25 bp, Rattus norvegicus
tttggaaatcaatgcctgggtttgc

SEQ ID NO: 694259 - DNA, 25 bp, Rattus norvegicus
tttggaaatccaaattcagcaccaa

SEQ ID NO: 694260 - DNA, 25 bp, Rattus norvegicus
tttggaaatccatattcagcaccaa

SEQ ID NO: 694261 - DNA, 25 bp, Rattus norvegicus
tttggaaatgatataacccttgacc

SEQ ID NO: 694262 - DNA, 25 bp, Rattus norvegicus
tttggaaatgatttaacccttgacc

SEQ ID NO: 694263 - DNA, 25 bp, Rattus norvegicus
tttggaaattccatgacaatgagaa

SEQ ID NO: 694264 - DNA, 25 bp, Rattus norvegicus
tttggaaattccttgacaatgagaa

SEQ ID NO: 694265 - DNA, 25 bp, Rattus norvegicus
tttggaaattggatgctttgcttct

SEQ ID NO: 694266 - DNA, 25 bp, Rattus norvegicus
tttggaaattggttgctttgcttct

SEQ ID NO: 694267 - DNA, 25 bp, Rattus norvegicus
tttggaacacagactacaagtaaag

SEQ ID NO: 694268 - DNA, 25 bp, Rattus norvegicus
tttggaacacagtctacaagtaaag

SEQ ID NO: 694269 - DNA, 25 bp, Rattus norvegicus
tttggaacactactcttacctgcgt

SEQ ID NO: 694270 - DNA, 25 bp, Rattus norvegicus
tttggaacactagtcttacctgcgt

SEQ ID NO: 694271 - DNA, 25 bp, Rattus norvegicus
tttggaacactcagccctcacacat

SEQ ID NO: 694272 - DNA, 25 bp, Rattus norvegicus
tttggaacactctgccctcacacat

SEQ ID NO: 694273 - DNA, 25 bp, Rattus norvegicus
tttggaacccctcgcgcttacaact

SEQ ID NO: 694274 - DNA, 25 bp, Rattus norvegicus
tttggaacccctggcgcttacaact

SEQ ID NO: 694275 - DNA, 25 bp, Rattus norvegicus
tttggaactaccaggagccagcgcc

SEQ ID NO: 694276 - DNA, 25 bp, Rattus norvegicus
tttggaactacctggagccagcgcc

SEQ ID NO: 694277 - DNA, 25 bp, Rattus norvegicus
tttggaactgaaagtgacagctcac

SEQ ID NO: 694278 - DNA, 25 bp, Rattus norvegicus
tttggaactgaatgtgacagctcac

SEQ ID NO: 694279 - DNA, 25 bp, Rattus norvegicus
tttggaactggaagtatccccgccg

SEQ ID NO: 694280 - DNA, 25 bp, Rattus norvegicus
tttggaactggatgtatccccgccg

SEQ ID NO: 694281 - DNA, 25 bp, Rattus norvegicus
tttggaactggtaatcccagcctgg

SEQ ID NO: 694282 - DNA, 25 bp, Rattus norvegicus
tttggaactggtcgtgtagccctca

SEQ ID NO: 694283 - DNA, 25 bp, Rattus norvegicus
tttggaactggtggtgtagccctca

SEQ ID NO: 694284 - DNA, 25 bp, Rattus norvegicus
tttggaactggttatcccagcctgg

SEQ ID NO: 694285 - DNA, 25 bp, Rattus norvegicus
tttggaacttgtatgctctctagca

SEQ ID NO: 694286 - DNA, 25 bp, Rattus norvegicus
tttggaacttgtttgctctctagca

SEQ ID NO: 694287 - DNA, 25 bp, Rattus norvegicus
tttggaagaacgctcaggcctgtga

SEQ ID NO: 694288 - DNA, 25 bp, Rattus norvegicus
tttggaagaacggtcaggcctgtga

SEQ ID NO: 694289 - DNA, 25 bp, Rattus norvegicus
tttggaagatcccttttgcttttgg

SEQ ID NO: 694290 - DNA, 25 bp, Rattus norvegicus
tttggaagatccgttttgcttttgg

SEQ ID NO: 694291 - DNA, 25 bp, Rattus norvegicus
tttggaataagcagggtgtcccttt

SEQ ID NO: 694292 - DNA, 25 bp, Rattus norvegicus
tttggaataagctgggtgtcccttt

SEQ ID NO: 694293 - DNA, 25 bp, Rattus norvegicus
tttggaatcaggctctttccccagc

SEQ ID NO: 694294 - DNA, 25 bp, Rattus norvegicus
tttggaatcagggtctttccccagc

SEQ ID NO: 694295 - DNA, 25 bp, Rattus norvegicus
tttggaatgcctctctaagacccac

SEQ ID NO: 694296 - DNA, 25 bp, Rattus norvegicus
tttggaatgcctgtctaagacccac

SEQ ID NO: 694297 - DNA, 25 bp, Rattus norvegicus
tttggaatgcttccctaaaccactc

SEQ ID NO: 694298 - DNA, 25 bp, Rattus norvegicus
tttggaatgcttgcctaaaccactc

SEQ ID NO: 694299 - DNA, 25 bp, Rattus norvegicus
tttggacaaactcaagtcctcccat

SEQ ID NO: 694300 - DNA, 25 bp, Rattus norvegicus
tttggacaaactgaagtcctcccat

SEQ ID NO: 694301 - DNA, 25 bp, Rattus norvegicus
tttggacaccacaatcacaccgagg

SEQ ID NO: 694302 - DNA, 25 bp, Rattus norvegicus
tttggacaccactatcacaccgagg

SEQ ID NO: 694303 - DNA, 25 bp, Rattus norvegicus
tttggacactagacccaactttgga

SEQ ID NO: 694304 - DNA, 25 bp, Rattus norvegicus
tttggacactagtcccaactttgga

SEQ ID NO: 694305 - DNA, 25 bp, Rattus norvegicus
tttggacactatcggcctttgaaca

SEQ ID NO: 694306 - DNA, 25 bp, Rattus norvegicus
tttggacactatgggcctttgaaca

SEQ ID NO: 694307 - DNA, 25 bp, Rattus norvegicus
tttggacactctaactattttatag

SEQ ID NO: 694308 - DNA, 25 bp, Rattus norvegicus
tttggacactcttactattttatag

SEQ ID NO: 694309 - DNA, 25 bp, Rattus norvegicus
tttggacagggtctttctgcttttg

SEQ ID NO: 694310 - DNA, 25 bp, Rattus norvegicus
tttggacagggtgtttctgcttttg

SEQ ID NO: 694311 - DNA, 25 bp, Rattus norvegicus
tttggacagtacctcctcacagcag

SEQ ID NO: 694312 - DNA, 25 bp, Rattus norvegicus
tttggacagtacgtcctcacagcag

SEQ ID NO: 694313 - DNA, 25 bp, Rattus norvegicus
tttggacattccactatggcatggt

SEQ ID NO: 694314 - DNA, 25 bp, Rattus norvegicus
tttggacattcctctatggcatggt

SEQ ID NO: 694315 - DNA, 25 bp, Rattus norvegicus
tttggacatttcaggcagcttttta

SEQ ID NO: 694316 - DNA, 25 bp, Rattus norvegicus
tttggacatttctggcagcttttta

SEQ ID NO: 694317 - DNA, 25 bp, Rattus norvegicus
tttggaccaccaatattaacttgaa

SEQ ID NO: 694318 - DNA, 25 bp, Rattus norvegicus
tttggaccaccattattaacttgaa

SEQ ID NO: 694319 - DNA, 25 bp, Rattus norvegicus
tttggaccacttctgcggtggctta

SEQ ID NO: 694320 - DNA, 25 bp, Rattus norvegicus
tttggaccacttgtgcggtggctta

SEQ ID NO: 694321 - DNA, 25 bp, Rattus norvegicus
tttggaccagcccttccactaaact

SEQ ID NO: 694322 - DNA, 25 bp, Rattus norvegicus
tttggaccagccgttccactaaact

SEQ ID NO: 694323 - DNA, 25 bp, Rattus norvegicus
tttggaccccaacatatcgatgaac

SEQ ID NO: 694324 - DNA, 25 bp, Rattus norvegicus
tttggaccccaagatatcgatgaac

SEQ ID NO: 694325 - DNA, 25 bp, Rattus norvegicus
tttggaccccggagacaaggcagga

SEQ ID NO: 694326 - DNA, 25 bp, Rattus norvegicus
tttggaccccggtgacaaggcagga

SEQ ID NO: 694327 - DNA, 25 bp, Rattus norvegicus
tttggacccggtagatcagaataaa

SEQ ID NO: 694328 - DNA, 25 bp, Rattus norvegicus
tttggacccggttgatcagaataaa

SEQ ID NO: 694329 - DNA, 25 bp, Rattus norvegicus
tttggaccgcatcaaggagctgcca

SEQ ID NO: 694330 - DNA, 25 bp, Rattus norvegicus
tttggaccgcatgaaggagctgcca

SEQ ID NO: 694331 - DNA, 25 bp, Rattus norvegicus
tttggacctattcctgttctgtttc

SEQ ID NO: 694332 - DNA, 25 bp, Rattus norvegicus
tttggacctattgctgttctgtttc

SEQ ID NO: 694333 - DNA, 25 bp, Rattus norvegicus
tttggacctcaccaacatggcggct

SEQ ID NO: 694334 - DNA, 25 bp, Rattus norvegicus
tttggacctcacgaacatggcggct

SEQ ID NO: 694335 - DNA, 25 bp, Rattus norvegicus
tttggacgtggaacttggtggcctc

SEQ ID NO: 694336 - DNA, 25 bp, Rattus norvegicus
tttggacgtggatcttggtggcctc

SEQ ID NO: 694337 - DNA, 25 bp, Rattus norvegicus
tttggactctctcagacgtctctgc

SEQ ID NO: 694338 - DNA, 25 bp, Rattus norvegicus
tttggactctctgagacgtctctgc

SEQ ID NO: 694339 - DNA, 25 bp, Rattus norvegicus
tttggactctgaatttctaacctat

SEQ ID NO: 694340 - DNA, 25 bp, Rattus norvegicus
tttggactctgattttctaacctat

SEQ ID NO: 694341 - DNA, 25 bp, Rattus norvegicus
tttggacttggcagaagcagctagt

SEQ ID NO: 694342 - DNA, 25 bp, Rattus norvegicus
tttggacttggctgaagcagctagt

SEQ ID NO: 694343 - DNA, 25 bp, Rattus norvegicus
tttggagaactactctcgtagctga

SEQ ID NO: 694344 - DNA, 25 bp, Rattus norvegicus
tttggagaactagtctcgtagctga

SEQ ID NO: 694345 - DNA, 25 bp, Rattus norvegicus
tttggagaactcacagacctcaggg

SEQ ID NO: 694346 - DNA, 25 bp, Rattus norvegicus
tttggagaactctcagacctcaggg

SEQ ID NO: 694347 - DNA, 25 bp, Rattus norvegicus
tttggagacaccagaaggcagcctt

SEQ ID NO: 694348 - DNA, 25 bp, Rattus norvegicus
tttggagacacctgaaggcagcctt

SEQ ID NO: 694349 - DNA, 25 bp, Rattus norvegicus
tttggagaccgcctagagttctcgg

SEQ ID NO: 694350 - DNA, 25 bp, Rattus norvegicus
tttggagaccgcgtagagttctcgg

SEQ ID NO: 694351 - DNA, 25 bp, Rattus norvegicus
tttggagacgagctggaacccagac

SEQ ID NO: 694352 - DNA, 25 bp, Rattus norvegicus
tttggagacgaggtggaacccagac

SEQ ID NO: 694353 - DNA, 25 bp, Rattus norvegicus
tttggagactgaagtccagcggcct

SEQ ID NO: 694354 - DNA, 25 bp, Rattus norvegicus
tttggagactgatgtccagcggcct

SEQ ID NO: 694355 - DNA, 25 bp, Rattus norvegicus
tttggagagctcagccgccagccag

SEQ ID NO: 694356 - DNA, 25 bp, Rattus norvegicus
tttggagagctcatattcttttgtg

SEQ ID NO: 694357 - DNA, 25 bp, Rattus norvegicus
tttggagagctctgccgccagccag

SEQ ID NO: 694358 - DNA, 25 bp, Rattus norvegicus
tttggagagctcttattcttttgtg

SEQ ID NO: 694359 - DNA, 25 bp, Rattus norvegicus
tttggagatgccagcactgccagga

SEQ ID NO: 694360 - DNA, 25 bp, Rattus norvegicus
tttggagatgcctgcactgccagga

SEQ ID NO: 694361 - DNA, 25 bp, Rattus norvegicus
tttggagcaatcctgttttcttttt

SEQ ID NO: 694362 - DNA, 25 bp, Rattus norvegicus
tttggagcaatcgtgttttcttttt

SEQ ID NO: 694363 - DNA, 25 bp, Rattus norvegicus
tttggagcagatcctcagggcgcca

SEQ ID NO: 694364 - DNA, 25 bp, Rattus norvegicus
tttggagcagatgctcagggcgcca

SEQ ID NO: 694365 - DNA, 25 bp, Rattus norvegicus
tttggagcagcacagcttctagcct

SEQ ID NO: 694366 - DNA, 25 bp, Rattus norvegicus
tttggagcagcacttgagtgccacc

SEQ ID NO: 694367 - DNA, 25 bp, Rattus norvegicus
tttggagcagcagagcttctagcct

SEQ ID NO: 694368 - DNA, 25 bp, Rattus norvegicus
tttggagcagcagttgagtgccacc

SEQ ID NO: 694369 - DNA, 25 bp, Rattus norvegicus
tttggagcagggaccatgtctttcc

SEQ ID NO: 694370 - DNA, 25 bp, Rattus norvegicus
tttggagcagggtccatgtctttcc

SEQ ID NO: 694371 - DNA, 25 bp, Rattus norvegicus
tttggagccaatacaccttgtgagc

SEQ ID NO: 694372 - DNA, 25 bp, Rattus norvegicus
tttggagccaattcaccttgtgagc

SEQ ID NO: 694373 - DNA, 25 bp, Rattus norvegicus
tttggagccaggatagagatcagca

SEQ ID NO: 694374 - DNA, 25 bp, Rattus norvegicus
tttggagccaggttagagatcagca

SEQ ID NO: 694375 - DNA, 25 bp, Rattus norvegicus
tttggagccattcccactggcatcc

SEQ ID NO: 694376 - DNA, 25 bp, Rattus norvegicus
tttggagccattgccactggcatcc

SEQ ID NO: 694377 - DNA, 25 bp, Rattus norvegicus
tttggagccgacaccacacataggt

SEQ ID NO: 694378 - DNA, 25 bp, Rattus norvegicus
tttggagccgactccacacataggt

SEQ ID NO: 694379 - DNA, 25 bp, Rattus norvegicus
tttggaggatagctcaggtgcgtta

SEQ ID NO: 694380 - DNA, 25 bp, Rattus norvegicus
tttggaggataggtcaggtgcgtta

SEQ ID NO: 694381 - DNA, 25 bp, Rattus norvegicus
tttggaggctggcagactaagacca

SEQ ID NO: 694382 - DNA, 25 bp, Rattus norvegicus
tttggaggctgggagactaagacca

SEQ ID NO: 694383 - DNA, 25 bp, Rattus norvegicus
tttggagggactccctatcttcatt

SEQ ID NO: 694384 - DNA, 25 bp, Rattus norvegicus
tttggagggactgcctatcttcatt

SEQ ID NO: 694385 - DNA, 25 bp, Rattus norvegicus
tttggagggtatacccagtctccat

SEQ ID NO: 694386 - DNA, 25 bp, Rattus norvegicus
tttggagggtattcccagtctccat

SEQ ID NO: 694387 - DNA, 25 bp, Rattus norvegicus
tttggaggtgctagatctatctaca

SEQ ID NO: 694388 - DNA, 25 bp, Rattus norvegicus
tttggaggtgcttgatctatctaca

SEQ ID NO: 694389 - DNA, 25 bp, Rattus norvegicus
tttggaggttagacacctacccact

SEQ ID NO: 694390 - DNA, 25 bp, Rattus norvegicus
tttggaggttagtcacctacccact

SEQ ID NO: 694391 - DNA, 25 bp, Rattus norvegicus
tttggaggttgtatctcttttctgc

SEQ ID NO: 694392 - DNA, 25 bp, Rattus norvegicus
tttggaggttgtttctcttttctgc

SEQ ID NO: 694393 - DNA, 25 bp, Rattus norvegicus
tttggagtagacattgcattcacaa

SEQ ID NO: 694394 - DNA, 25 bp, Rattus norvegicus
tttggagtagactttgcattcacaa

SEQ ID NO: 694395 - DNA, 25 bp, Rattus norvegicus
tttggagtaggcaacgccaagcccc

SEQ ID NO: 694396 - DNA, 25 bp, Rattus norvegicus
tttggagtaggctacgccaagcccc

SEQ ID NO: 694397 - DNA, 25 bp, Rattus norvegicus
tttggagtcacccacgtcaatcgga

SEQ ID NO: 694398 - DNA, 25 bp, Rattus norvegicus
tttggagtcaccgacgtcaatcgga

SEQ ID NO: 694399 - DNA, 25 bp, Rattus norvegicus
tttggagtcccaatcattagataat

SEQ ID NO: 694400 - DNA, 25 bp, Rattus norvegicus
tttggagtcccattcattagataat

SEQ ID NO: 694401 - DNA, 25 bp, Rattus norvegicus
tttggagtcgtacctgggtccctga

SEQ ID NO: 694402 - DNA, 25 bp, Rattus norvegicus
tttggagtcgtagctgggtccctga

SEQ ID NO: 694403 - DNA, 25 bp, Rattus norvegicus
tttggagtgcttataatcctgatga

SEQ ID NO: 694404 - DNA, 25 bp, Rattus norvegicus
tttggagtgcttttaatcctgatga

SEQ ID NO: 694405 - DNA, 25 bp, Rattus norvegicus
tttggagttcataggtcacactgac

SEQ ID NO: 694406 - DNA, 25 bp, Rattus norvegicus
tttggagttcatcctccgtaagccc

SEQ ID NO: 694407 - DNA, 25 bp, Rattus norvegicus
tttggagttcatgctccgtaagccc

SEQ ID NO: 694408 - DNA, 25 bp, Rattus norvegicus
tttggagttcattggtcacactgac

SEQ ID NO: 694409 - DNA, 25 bp, Rattus norvegicus
tttggagtttgcagacatgccctct

SEQ ID NO: 694410 - DNA, 25 bp, Rattus norvegicus
tttggagtttgctgacatgccctct

SEQ ID NO: 694411 - DNA, 25 bp, Rattus norvegicus
tttggataatccctggctggtctct

SEQ ID NO: 694412 - DNA, 25 bp, Rattus norvegicus
tttggataatccgtggctggtctct

SEQ ID NO: 694413 - DNA, 25 bp, Rattus norvegicus
tttggatatagcaggtcgggacctc

SEQ ID NO: 694414 - DNA, 25 bp, Rattus norvegicus
tttggatatagctggtcgggacctc

SEQ ID NO: 694415 - DNA, 25 bp, Rattus norvegicus
tttggatccagcatccgtgggcaga

SEQ ID NO: 694416 - DNA, 25 bp, Rattus norvegicus
tttggatccagcttccgtgggcaga

SEQ ID NO: 694417 - DNA, 25 bp, Rattus norvegicus
tttggatccgataacaaagcccatt

SEQ ID NO: 694418 - DNA, 25 bp, Rattus norvegicus
tttggatccgattacaaagcccatt

SEQ ID NO: 694419 - DNA, 25 bp, Rattus norvegicus
tttggatccgcaagcaagggtccgt

SEQ ID NO: 694420 - DNA, 25 bp, Rattus norvegicus
tttggatccgcatgcaagggtccgt

SEQ ID NO: 694421 - DNA, 25 bp, Rattus norvegicus
tttggatcctgcaatgtagccctct

SEQ ID NO: 694422 - DNA, 25 bp, Rattus norvegicus
tttggatcctgctatgtagccctct

SEQ ID NO: 694423 - DNA, 25 bp, Rattus norvegicus
tttggatgagctagggaagcgttat

SEQ ID NO: 694424 - DNA, 25 bp, Rattus norvegicus
tttggatgagcttgggaagcgttat

SEQ ID NO: 694425 - DNA, 25 bp, Rattus norvegicus
tttggatgcgatccacaggctctgt

SEQ ID NO: 694426 - DNA, 25 bp, Rattus norvegicus
tttggatgcgatgcacaggctctgt

SEQ ID NO: 694427 - DNA, 25 bp, Rattus norvegicus
tttggatggcacagggccctggaca

SEQ ID NO: 694428 - DNA, 25 bp, Rattus norvegicus
tttggatggcactgggccctggaca

SEQ ID NO: 694429 - DNA, 25 bp, Rattus norvegicus
tttggatggcctcaagaggaccaca

SEQ ID NO: 694430 - DNA, 25 bp, Rattus norvegicus
tttggatggcctgaagaggaccaca

SEQ ID NO: 694431 - DNA, 25 bp, Rattus norvegicus
tttggatgggcacccgtgcagcaca

SEQ ID NO: 694432 - DNA, 25 bp, Rattus norvegicus
tttggatgggcagccgtgcagcaca

SEQ ID NO: 694433 - DNA, 25 bp, Rattus norvegicus
tttggatgttgaaagttcacggcat

SEQ ID NO: 694434 - DNA, 25 bp, Rattus norvegicus
tttggatgttgatagttcacggcat

SEQ ID NO: 694435 - DNA, 25 bp, Rattus norvegicus
tttggatgtttgagctgcccttgac

SEQ ID NO: 694436 - DNA, 25 bp, Rattus norvegicus
tttggatgtttgtgctgcccttgac

SEQ ID NO: 694437 - DNA, 25 bp, Rattus norvegicus
tttggatgttttagagcgctgctct

SEQ ID NO: 694438 - DNA, 25 bp, Rattus norvegicus
tttggatgtttttgagcgctgctct

SEQ ID NO: 694439 - DNA, 25 bp, Rattus norvegicus
tttggattctgcacttgtttctaca

SEQ ID NO: 694440 - DNA, 25 bp, Rattus norvegicus
tttggattctgctcttgtttctaca

SEQ ID NO: 694441 - DNA, 25 bp, Rattus norvegicus
tttggatttcaaagcctggttggac

SEQ ID NO: 694442 - DNA, 25 bp, Rattus norvegicus
tttggatttcaatgcctggttggac

SEQ ID NO: 694443 - DNA, 25 bp, Rattus norvegicus
tttggatttcagctccagcctagaa

SEQ ID NO: 694444 - DNA, 25 bp, Rattus norvegicus
tttggatttcaggtccagcctagaa

SEQ ID NO: 694445 - DNA, 25 bp, Rattus norvegicus
tttggatttgaacggcggtctccct

SEQ ID NO: 694446 - DNA, 25 bp, Rattus norvegicus
tttggatttgaagggcggtctccct

SEQ ID NO: 694447 - DNA, 25 bp, Rattus norvegicus
tttggatttgggattcctgcagccc

SEQ ID NO: 694448 - DNA, 25 bp, Rattus norvegicus
tttggatttgggtttcctgcagccc

SEQ ID NO: 694449 - DNA, 25 bp, Rattus norvegicus
tttggattttgaatgtcggccctgt

SEQ ID NO: 694450 - DNA, 25 bp, Rattus norvegicus
tttggattttgattgtcggccctgt

SEQ ID NO: 694451 - DNA, 25 bp, Rattus norvegicus
tttggattttggaacaggcagtctg

SEQ ID NO: 694452 - DNA, 25 bp, Rattus norvegicus
tttggattttggtacaggcagtctg

SEQ ID NO: 694453 - DNA, 25 bp, Rattus norvegicus
tttggcaaagccattagcctgctac

SEQ ID NO: 694454 - DNA, 25 bp, Rattus norvegicus
tttggcaaagcctttagcctgctac

SEQ ID NO: 694455 - DNA, 25 bp, Rattus norvegicus
tttggcaaatggcacaggatcttat

SEQ ID NO: 694456 - DNA, 25 bp, Rattus norvegicus
tttggcaaatgggacaggatcttat

SEQ ID NO: 694457 - DNA, 25 bp, Rattus norvegicus
tttggcaaattgagtcttttatgtt

SEQ ID NO: 694458 - DNA, 25 bp, Rattus norvegicus
tttggcaaattgtgtcttttatgtt

SEQ ID NO: 694459 - DNA, 25 bp, Rattus norvegicus
tttggcaagccacctactgaggagc

SEQ ID NO: 694460 - DNA, 25 bp, Rattus norvegicus
tttggcaagccagctactgaggagc

SEQ ID NO: 694461 - DNA, 25 bp, Rattus norvegicus
tttggcaagtgcagtgaccctgttg

SEQ ID NO: 694462 - DNA, 25 bp, Rattus norvegicus
tttggcaagtgctgtgaccctgttg

SEQ ID NO: 694463 - DNA, 25 bp, Rattus norvegicus
tttggcaagttaaacttcagccccg

SEQ ID NO: 694464 - DNA, 25 bp, Rattus norvegicus
tttggcaagttatacttcagccccg

SEQ ID NO: 694465 - DNA, 25 bp, Rattus norvegicus
tttggcacatagctttatacttgat

SEQ ID NO: 694466 - DNA, 25 bp, Rattus norvegicus
tttggcacataggtttatacttgat

SEQ ID NO: 694467 - DNA, 25 bp, Rattus norvegicus
tttggcacatttacttggacacttt

SEQ ID NO: 694468 - DNA, 25 bp, Rattus norvegicus
tttggcacattttcttggacacttt

SEQ ID NO: 694469 - DNA, 25 bp, Rattus norvegicus
tttggcactatgctagggttgagct

SEQ ID NO: 694470 - DNA, 25 bp, Rattus norvegicus
tttggcactatggtagggttgagct

SEQ ID NO: 694471 - DNA, 25 bp, Rattus norvegicus
tttggcactgagcactgcttgacct

SEQ ID NO: 694472 - DNA, 25 bp, Rattus norvegicus
tttggcactgaggactgcttgacct

SEQ ID NO: 694473 - DNA, 25 bp, Rattus norvegicus
tttggcagactcctttttgggtact

SEQ ID NO: 694474 - DNA, 25 bp, Rattus norvegicus
tttggcagactcgtttttgggtact

SEQ ID NO: 694475 - DNA, 25 bp, Rattus norvegicus
tttggcagctcaaagccacgtgtga

SEQ ID NO: 694476 - DNA, 25 bp, Rattus norvegicus
tttggcagctcatagccacgtgtga

SEQ ID NO: 694477 - DNA, 25 bp, Rattus norvegicus
tttggcagctttagtgctccttaga

SEQ ID NO: 694478 - DNA, 25 bp, Rattus norvegicus
tttggcagcttttgtgctccttaga

SEQ ID NO: 694479 - DNA, 25 bp, Rattus norvegicus
tttggcaggccacgaggacagcaac

SEQ ID NO: 694480 - DNA, 25 bp, Rattus norvegicus
tttggcaggccaggaggacagcaac

SEQ ID NO: 694481 - DNA, 25 bp, Rattus norvegicus
tttggcagtgacatacctgtctact

SEQ ID NO: 694482 - DNA, 25 bp, Rattus norvegicus
tttggcagtgacttacctgtctact

SEQ ID NO: 694483 - DNA, 25 bp, Rattus norvegicus
tttggcagtttcactagtggtcccc

SEQ ID NO: 694484 - DNA, 25 bp, Rattus norvegicus
tttggcagtttctctagtggtcccc

SEQ ID NO: 694485 - DNA, 25 bp, Rattus norvegicus
tttggcatcatcagcatggaggatc

SEQ ID NO: 694486 - DNA, 25 bp, Rattus norvegicus
tttggcatcatctgcatggaggatc

SEQ ID NO: 694487 - DNA, 25 bp, Rattus norvegicus
tttggcatccacaacattgtcttcg

SEQ ID NO: 694488 - DNA, 25 bp, Rattus norvegicus
tttggcatccacaggttcctgttaa

SEQ ID NO: 694489 - DNA, 25 bp, Rattus norvegicus
tttggcatccactacattgtcttcg

SEQ ID NO: 694490 - DNA, 25 bp, Rattus norvegicus
tttggcatccactggttcctgttaa

SEQ ID NO: 694491 - DNA, 25 bp, Rattus norvegicus
tttggcatctgtacgaatgtcctca

SEQ ID NO: 694492 - DNA, 25 bp, Rattus norvegicus
tttggcatctgttcgaatgtcctca

SEQ ID NO: 694493 - DNA, 25 bp, Rattus norvegicus
tttggcatgactcggatgctgtgct

SEQ ID NO: 694494 - DNA, 25 bp, Rattus norvegicus
tttggcatgactgggatgctgtgct

SEQ ID NO: 694495 - DNA, 25 bp, Rattus norvegicus
tttggcatgcttagaggtccattgc

SEQ ID NO: 694496 - DNA, 25 bp, Rattus norvegicus
tttggcatgcttccgacccaatgga

SEQ ID NO: 694497 - DNA, 25 bp, Rattus norvegicus
tttggcatgcttgcgacccaatgga

SEQ ID NO: 694498 - DNA, 25 bp, Rattus norvegicus
tttggcatgctttgaggtccattgc

SEQ ID NO: 694499 - DNA, 25 bp, Rattus norvegicus
tttggcatggttctctatttctgta

SEQ ID NO: 694500 - DNA, 25 bp, Rattus norvegicus
tttggcatggttgtctatttctgta

SEQ ID NO: 694501 - DNA, 25 bp, Rattus norvegicus
tttggcattttgcagacacttgtct

SEQ ID NO: 694502 - DNA, 25 bp, Rattus norvegicus
tttggcattttggagacacttgtct

SEQ ID NO: 694503 - DNA, 25 bp, Rattus norvegicus
tttggccaaactacatttcttcttt

SEQ ID NO: 694504 - DNA, 25 bp, Rattus norvegicus
tttggccaaacttcatttcttcttt

SEQ ID NO: 694505 - DNA, 25 bp, Rattus norvegicus
tttggccaaatccttaagttcatat

SEQ ID NO: 694506 - DNA, 25 bp, Rattus norvegicus
tttggccaaatcgttaagttcatat

SEQ ID NO: 694507 - DNA, 25 bp, Rattus norvegicus
tttggccaacttccctctgctgaag

SEQ ID NO: 694508 - DNA, 25 bp, Rattus norvegicus
tttggccaacttgcctctgctgaag

SEQ ID NO: 694509 - DNA, 25 bp, Rattus norvegicus
tttggccaatgaaatgacgtccctt

SEQ ID NO: 694510 - DNA, 25 bp, Rattus norvegicus
tttggccaatgatatgacgtccctt

SEQ ID NO: 694511 - DNA, 25 bp, Rattus norvegicus
tttggccaatgcagtctccagaatc

SEQ ID NO: 694512 - DNA, 25 bp, Rattus norvegicus
tttggccaatgctgtctccagaatc

SEQ ID NO: 694513 - DNA, 25 bp, Rattus norvegicus
tttggccaatggcaaaaacggtgaa

SEQ ID NO: 694514 - DNA, 25 bp, Rattus norvegicus
tttggccaatgggaaaaacggtgaa

SEQ ID NO: 694515 - DNA, 25 bp, Rattus norvegicus
tttggccacaataccttcaagcttg

SEQ ID NO: 694516 - DNA, 25 bp, Rattus norvegicus
tttggccacaattccttcaagcttg

SEQ ID NO: 694517 - DNA, 25 bp, Rattus norvegicus
tttggccacacccaagctgcagctg

SEQ ID NO: 694518 - DNA, 25 bp, Rattus norvegicus
tttggccacaccgaagctgcagctg

SEQ ID NO: 694519 - DNA, 25 bp, Rattus norvegicus
tttggccactacagagaccttcaaa

SEQ ID NO: 694520 - DNA, 25 bp, Rattus norvegicus
tttggccactactgagaccttcaaa

SEQ ID NO: 694521 - DNA, 25 bp, Rattus norvegicus
tttggccagagacgcctcctgctgg

SEQ ID NO: 694522 - DNA, 25 bp, Rattus norvegicus
tttggccagagaggcctcctgctgg

SEQ ID NO: 694523 - DNA, 25 bp, Rattus norvegicus
tttggccagcaaagcacattacttt

SEQ ID NO: 694524 - DNA, 25 bp, Rattus norvegicus
tttggccagcaatgcacattacttt

SEQ ID NO: 694525 - DNA, 25 bp, Rattus norvegicus
tttggccagtggatcctttgacaag

SEQ ID NO: 694526 - DNA, 25 bp, Rattus norvegicus
tttggccagtggttcctttgacaag

SEQ ID NO: 694527 - DNA, 25 bp, Rattus norvegicus
tttggccatgatctcttttcccttc

SEQ ID NO: 694528 - DNA, 25 bp, Rattus norvegicus
tttggccatgatgtcttttcccttc

SEQ ID NO: 694529 - DNA, 25 bp, Rattus norvegicus
tttggccattgcaccatcggcatca

SEQ ID NO: 694530 - DNA, 25 bp, Rattus norvegicus
tttggccattgctccatcggcatca

SEQ ID NO: 694531 - DNA, 25 bp, Rattus norvegicus
tttggcccagacatgctcgaatttg

SEQ ID NO: 694532 - DNA, 25 bp, Rattus norvegicus
tttggcccagacttgctcgaatttg

SEQ ID NO: 694533 - DNA, 25 bp, Rattus norvegicus
tttggccccactacagataaaggaa

SEQ ID NO: 694534 - DNA, 25 bp, Rattus norvegicus
tttggccccacttcagataaaggaa

SEQ ID NO: 694535 - DNA, 25 bp, Rattus norvegicus
tttggccccagaacgaagatcactt

SEQ ID NO: 694536 - DNA, 25 bp, Rattus norvegicus
tttggccccagatcgaagatcactt

SEQ ID NO: 694537 - DNA, 25 bp, Rattus norvegicus
tttggccccgcaactttgaacattc

SEQ ID NO: 694538 - DNA, 25 bp, Rattus norvegicus
tttggccccgcatctttgaacattc

SEQ ID NO: 694539 - DNA, 25 bp, Rattus norvegicus
tttggcccctttcgcgcagtgaaca

SEQ ID NO: 694540 - DNA, 25 bp, Rattus norvegicus
tttggcccctttggcgcagtgaaca

SEQ ID NO: 694541 - DNA, 25 bp, Rattus norvegicus
tttggccctggcaagatggactcca

SEQ ID NO: 694542 - DNA, 25 bp, Rattus norvegicus
tttggccctggctagatggactcca

SEQ ID NO: 694543 - DNA, 25 bp, Rattus norvegicus
tttggccctgtaccaggagcacaga

SEQ ID NO: 694544 - DNA, 25 bp, Rattus norvegicus
tttggccctgtagcaggagcacaga

SEQ ID NO: 694545 - DNA, 25 bp, Rattus norvegicus
tttggccgcctgaggttcttgatat

SEQ ID NO: 694546 - DNA, 25 bp, Rattus norvegicus
tttggccgcctgtggttcttgatat

SEQ ID NO: 694547 - DNA, 25 bp, Rattus norvegicus
tttggccgctcgaaatgactgcatg

SEQ ID NO: 694548 - DNA, 25 bp, Rattus norvegicus
tttggccgctcgtaatgactgcatg

SEQ ID NO: 694549 - DNA, 25 bp, Rattus norvegicus
tttggccgcttcactcctggaagct

SEQ ID NO: 694550 - DNA, 25 bp, Rattus norvegicus
tttggccgcttctctcctggaagct

SEQ ID NO: 694551 - DNA, 25 bp, Rattus norvegicus
tttggcctatgacctctgacagcag

SEQ ID NO: 694552 - DNA, 25 bp, Rattus norvegicus
tttggcctatgagctctgacagcag

SEQ ID NO: 694553 - DNA, 25 bp, Rattus norvegicus
tttggcctcaagctggaccggatcg

SEQ ID NO: 694554 - DNA, 25 bp, Rattus norvegicus
tttggcctcaaggtggaccggatcg

SEQ ID NO: 694555 - DNA, 25 bp, Rattus norvegicus
tttggcctcatcaagcaaccaggaa

SEQ ID NO: 694556 - DNA, 25 bp, Rattus norvegicus
tttggcctcatcctcattgagggaa

SEQ ID NO: 694557 - DNA, 25 bp, Rattus norvegicus
tttggcctcatcgtcattgagggaa

SEQ ID NO: 694558 - DNA, 25 bp, Rattus norvegicus
tttggcctcatctagcaaccaggaa

SEQ ID NO: 694559 - DNA, 25 bp, Rattus norvegicus
tttggcctccgcagggttgaagctg

SEQ ID NO: 694560 - DNA, 25 bp, Rattus norvegicus
tttggcctccgctgggttgaagctg

SEQ ID NO: 694561 - DNA, 25 bp, Rattus norvegicus
tttggcctctgaagccagacagtta

SEQ ID NO: 694562 - DNA, 25 bp, Rattus norvegicus
tttggcctctgaccctttttccaca

SEQ ID NO: 694563 - DNA, 25 bp, Rattus norvegicus
tttggcctctgactcctgcacagtt

SEQ ID NO: 694564 - DNA, 25 bp, Rattus norvegicus
tttggcctctgagcctttttccaca

SEQ ID NO: 694565 - DNA, 25 bp, Rattus norvegicus
tttggcctctgagtcctgcacagtt

SEQ ID NO: 694566 - DNA, 25 bp, Rattus norvegicus
tttggcctctgatgccagacagtta

SEQ ID NO: 694567 - DNA, 25 bp, Rattus norvegicus
tttggcctctggagtcctttgtact

SEQ ID NO: 694568 - DNA, 25 bp, Rattus norvegicus
tttggcctctggtgtcctttgtact

SEQ ID NO: 694569 - DNA, 25 bp, Rattus norvegicus
tttggcctcttcatcaaaaggtaca

SEQ ID NO: 694570 - DNA, 25 bp, Rattus norvegicus
tttggcctcttcttcaaaaggtaca

SEQ ID NO: 694571 - DNA, 25 bp, Rattus norvegicus
tttggcctcttgcacaagtgtgagt

SEQ ID NO: 694572 - DNA, 25 bp, Rattus norvegicus
tttggcctcttggacaagtgtgagt

SEQ ID NO: 694573 - DNA, 25 bp, Rattus norvegicus
tttggcctgcagctggtgtacgtaa

SEQ ID NO: 694574 - DNA, 25 bp, Rattus norvegicus
tttggcctgcaggtggtgtacgtaa

SEQ ID NO: 694575 - DNA, 25 bp, Rattus norvegicus
tttggcctgcggcagattgctaaac

SEQ ID NO: 694576 - DNA, 25 bp, Rattus norvegicus
tttggcctgcgggagattgctaaac

SEQ ID NO: 694577 - DNA, 25 bp, Rattus norvegicus
tttggcctggcccatttgaaggcaa

SEQ ID NO: 694578 - DNA, 25 bp, Rattus norvegicus
tttggcctggccgatttgaaggcaa

SEQ ID NO: 694579 - DNA, 25 bp, Rattus norvegicus
tttggccttgaaaaagctgactgaa

SEQ ID NO: 694580 - DNA, 25 bp, Rattus norvegicus
tttggccttgaataagctgactgaa

SEQ ID NO: 694581 - DNA, 25 bp, Rattus norvegicus
tttggcgaactcaataccaccatca

SEQ ID NO: 694582 - DNA, 25 bp, Rattus norvegicus
tttggcgaactctataccaccatca

SEQ ID NO: 694583 - DNA, 25 bp, Rattus norvegicus
tttggcgacagtcagtccagcgtga

SEQ ID NO: 694584 - DNA, 25 bp, Rattus norvegicus
tttggcgacagtgagtccagcgtga

SEQ ID NO: 694585 - DNA, 25 bp, Rattus norvegicus
tttggcgagattaccatctttgaag

SEQ ID NO: 694586 - DNA, 25 bp, Rattus norvegicus
tttggcgagatttccatctttgaag

SEQ ID NO: 694587 - DNA, 25 bp, Rattus norvegicus
tttggcggccctataatctctggag

SEQ ID NO: 694588 - DNA, 25 bp, Rattus norvegicus
tttggcggccctttaatctctggag

SEQ ID NO: 694589 - DNA, 25 bp, Rattus norvegicus
tttggcgtcctcaaataggccagca

SEQ ID NO: 694590 - DNA, 25 bp, Rattus norvegicus
tttggcgtcctctaataggccagca

SEQ ID NO: 694591 - DNA, 25 bp, Rattus norvegicus
tttggcgtcttcacagacacagctc

SEQ ID NO: 694592 - DNA, 25 bp, Rattus norvegicus
tttggcgtcttctcagacacagctc

SEQ ID NO: 694593 - DNA, 25 bp, Rattus norvegicus
tttggctaacctccctacagtgtga

SEQ ID NO: 694594 - DNA, 25 bp, Rattus norvegicus
tttggctaacctgcctacagtgtga

SEQ ID NO: 694595 - DNA, 25 bp, Rattus norvegicus
tttggctaacttcctagaatccctg

SEQ ID NO: 694596 - DNA, 25 bp, Rattus norvegicus
tttggctaacttgctagaatccctg

SEQ ID NO: 694597 - DNA, 25 bp, Rattus norvegicus
tttggctaccaaacttaggctagta

SEQ ID NO: 694598 - DNA, 25 bp, Rattus norvegicus
tttggctaccaatcttaggctagta

SEQ ID NO: 694599 - DNA, 25 bp, Rattus norvegicus
tttggctaccccaaatttgtagcat

SEQ ID NO: 694600 - DNA, 25 bp, Rattus norvegicus
tttggctacccctaatttgtagcat

SEQ ID NO: 694601 - DNA, 25 bp, Rattus norvegicus
tttggctactgacgacactagtcac

SEQ ID NO: 694602 - DNA, 25 bp, Rattus norvegicus
tttggctactgaggacactagtcac

SEQ ID NO: 694603 - DNA, 25 bp, Rattus norvegicus
tttggctattctcatgctgcactta

SEQ ID NO: 694604 - DNA, 25 bp, Rattus norvegicus
tttggctattctgatgctgcactta

SEQ ID NO: 694605 - DNA, 25 bp, Rattus norvegicus
tttggctcaaagactaactagacac

SEQ ID NO: 694606 - DNA, 25 bp, Rattus norvegicus
tttggctcaaagtctaactagacac

SEQ ID NO: 694607 - DNA, 25 bp, Rattus norvegicus
tttggctcaagcaccattttggtgt

SEQ ID NO: 694608 - DNA, 25 bp, Rattus norvegicus
tttggctcaagctccattttggtgt

SEQ ID NO: 694609 - DNA, 25 bp, Rattus norvegicus
tttggctcacagatcacgtgtacag

SEQ ID NO: 694610 - DNA, 25 bp, Rattus norvegicus
tttggctcacagttcacgtgtacag

SEQ ID NO: 694611 - DNA, 25 bp, Rattus norvegicus
tttggctcaccaagcatgagaccat

SEQ ID NO: 694612 - DNA, 25 bp, Rattus norvegicus
tttggctcaccatgcatgagaccat

SEQ ID NO: 694613 - DNA, 25 bp, Rattus norvegicus
tttggctccattcctgtggtagaag

SEQ ID NO: 694614 - DNA, 25 bp, Rattus norvegicus
tttggctccattgctgtggtagaag

SEQ ID NO: 694615 - DNA, 25 bp, Rattus norvegicus
tttggctcccaacatcgaagatgaa

SEQ ID NO: 694616 - DNA, 25 bp, Rattus norvegicus
tttggctcccaacgatggctatttc

SEQ ID NO: 694617 - DNA, 25 bp, Rattus norvegicus
tttggctcccaagatcgaagatgaa

SEQ ID NO: 694618 - DNA, 25 bp, Rattus norvegicus
tttggctcccaaggatggctatttc

SEQ ID NO: 694619 - DNA, 25 bp, Rattus norvegicus
tttggctcccatctggtcagagtta

SEQ ID NO: 694620 - DNA, 25 bp, Rattus norvegicus
tttggctcccatgtggtcagagtta

SEQ ID NO: 694621 - DNA, 25 bp, Rattus norvegicus
tttggctccccgattgagcagctgt

SEQ ID NO: 694622 - DNA, 25 bp, Rattus norvegicus
tttggctccccgtttgagcagctgt

SEQ ID NO: 694623 - DNA, 25 bp, Rattus norvegicus
tttggctcctgtcgtgcataaatga

SEQ ID NO: 694624 - DNA, 25 bp, Rattus norvegicus
tttggctcctgtggtgcataaatga

SEQ ID NO: 694625 - DNA, 25 bp, Rattus norvegicus
tttggctcttgtacggtgaaaatcc

SEQ ID NO: 694626 - DNA, 25 bp, Rattus norvegicus
tttggctcttgtcttctttgatgtc

SEQ ID NO: 694627 - DNA, 25 bp, Rattus norvegicus
tttggctcttgtgttctttgatgtc

SEQ ID NO: 694628 - DNA, 25 bp, Rattus norvegicus
tttggctcttgttcggtgaaaatcc

SEQ ID NO: 694629 - DNA, 25 bp, Rattus norvegicus
tttggctgaaagcaggtcctgtccc

SEQ ID NO: 694630 - DNA, 25 bp, Rattus norvegicus
tttggctgaaaggaggtcctgtccc

SEQ ID NO: 694631 - DNA, 25 bp, Rattus norvegicus
tttggctgaagcagggacgggctgg

SEQ ID NO: 694632 - DNA, 25 bp, Rattus norvegicus
tttggctgaagctgggacgggctgg

SEQ ID NO: 694633 - DNA, 25 bp, Rattus norvegicus
tttggctgagcaagtgaccaggcat

SEQ ID NO: 694634 - DNA, 25 bp, Rattus norvegicus
tttggctgagcactggctgctgtct

SEQ ID NO: 694635 - DNA, 25 bp, Rattus norvegicus
tttggctgagcagtggctgctgtct

SEQ ID NO: 694636 - DNA, 25 bp, Rattus norvegicus
tttggctgagcatgtgaccaggcat

SEQ ID NO: 694637 - DNA, 25 bp, Rattus norvegicus
tttggctgatggctaaattgtcctg

SEQ ID NO: 694638 - DNA, 25 bp, Rattus norvegicus
tttggctgatgggtaaattgtcctg

SEQ ID NO: 694639 - DNA, 25 bp, Rattus norvegicus
tttggctgcaagattgtcattcccc

SEQ ID NO: 694640 - DNA, 25 bp, Rattus norvegicus
tttggctgcaagtttgtcattcccc

SEQ ID NO: 694641 - DNA, 25 bp, Rattus norvegicus
tttggctgccacatgtgtggtttca

SEQ ID NO: 694642 - DNA, 25 bp, Rattus norvegicus
tttggctgccacttgtgtggtttca

SEQ ID NO: 694643 - DNA, 25 bp, Rattus norvegicus
tttggctgccatatcacagtctgta

SEQ ID NO: 694644 - DNA, 25 bp, Rattus norvegicus
tttggctgccatttcacagtctgta

SEQ ID NO: 694645 - DNA, 25 bp, Rattus norvegicus
tttggctgcttgcttgggttttctc

SEQ ID NO: 694646 - DNA, 25 bp, Rattus norvegicus
tttggctgcttggttgggttttctc

SEQ ID NO: 694647 - DNA, 25 bp, Rattus norvegicus
tttggctgtaaaactgcaacttgta

SEQ ID NO: 694648 - DNA, 25 bp, Rattus norvegicus
tttggctgtaaatctgcaacttgta

SEQ ID NO: 694649 - DNA, 25 bp, Rattus norvegicus
tttggctgtcaaacatgggcatcat

SEQ ID NO: 694650 - DNA, 25 bp, Rattus norvegicus
tttggctgtcaatcatgggcatcat

SEQ ID NO: 694651 - DNA, 25 bp, Rattus norvegicus
tttggctgtctgagggcactggcac

SEQ ID NO: 694652 - DNA, 25 bp, Rattus norvegicus
tttggctgtctgtgggcactggcac

SEQ ID NO: 694653 - DNA, 25 bp, Rattus norvegicus
tttggcttaaatcggcttagtggga

SEQ ID NO: 694654 - DNA, 25 bp, Rattus norvegicus
tttggcttaaatgggcttagtggga

SEQ ID NO: 694655 - DNA, 25 bp, Rattus norvegicus
tttggcttcatcacctatcagggat

SEQ ID NO: 694656 - DNA, 25 bp, Rattus norvegicus
tttggcttcatctcctatcagggat

SEQ ID NO: 694657 - DNA, 25 bp, Rattus norvegicus
tttggcttccataggcaatgcatac

SEQ ID NO: 694658 - DNA, 25 bp, Rattus norvegicus
tttggcttccattggcaatgcatac

SEQ ID NO: 694659 - DNA, 25 bp, Rattus norvegicus
tttggcttctggatgagttcactca

SEQ ID NO: 694660 - DNA, 25 bp, Rattus norvegicus
tttggcttctggttgagttcactca

SEQ ID NO: 694661 - DNA, 25 bp, Rattus norvegicus
tttggcttggagacacacacctgta

SEQ ID NO: 694662 - DNA, 25 bp, Rattus norvegicus
tttggcttggagtcacacacctgta

SEQ ID NO: 694663 - DNA, 25 bp, Rattus norvegicus
tttggctttagcctgctcttggtcc

SEQ ID NO: 694664 - DNA, 25 bp, Rattus norvegicus
tttggctttagcgtgctcttggtcc

SEQ ID NO: 694665 - DNA, 25 bp, Rattus norvegicus
tttggctttatgaccagggttgccc

SEQ ID NO: 694666 - DNA, 25 bp, Rattus norvegicus
tttggctttatgtccagggttgccc

SEQ ID NO: 694667 - DNA, 25 bp, Rattus norvegicus
tttggctttcttctcggagctgagc

SEQ ID NO: 694668 - DNA, 25 bp, Rattus norvegicus
tttggctttcttgtcggagctgagc

SEQ ID NO: 694669 - DNA, 25 bp, Rattus norvegicus
tttggctttgtcagcattgtgactt

SEQ ID NO: 694670 - DNA, 25 bp, Rattus norvegicus
tttggctttgtctgcattgtgactt

SEQ ID NO: 694671 - DNA, 25 bp, Rattus norvegicus
tttgggaaaaacatcacacacaggg

SEQ ID NO: 694672 - DNA, 25 bp, Rattus norvegicus
tttgggaaaaacttcacacacaggg

SEQ ID NO: 694673 - DNA, 25 bp, Rattus norvegicus
tttgggaacatcagacgagcacact

SEQ ID NO: 694674 - DNA, 25 bp, Rattus norvegicus
tttgggaacatctgacgagcacact

SEQ ID NO: 694675 - DNA, 25 bp, Rattus norvegicus
tttgggaacctgacgcggatacggc

SEQ ID NO: 694676 - DNA, 25 bp, Rattus norvegicus
tttgggaacctgtcgcggatacggc

SEQ ID NO: 694677 - DNA, 25 bp, Rattus norvegicus
tttgggaagacaacctgcagctgga

SEQ ID NO: 694678 - DNA, 25 bp, Rattus norvegicus
tttgggaagacatcctgcagctgga

SEQ ID NO: 694679 - DNA, 25 bp, Rattus norvegicus
tttgggaagcctcagccacccctga

SEQ ID NO: 694680 - DNA, 25 bp, Rattus norvegicus
tttgggaagcctgagccacccctga

SEQ ID NO: 694681 - DNA, 25 bp, Rattus norvegicus
tttgggaagctccatctccctgtgg

SEQ ID NO: 694682 - DNA, 25 bp, Rattus norvegicus
tttgggaagctcgatctccctgtgg

SEQ ID NO: 694683 - DNA, 25 bp, Rattus norvegicus
tttgggaagcttaatgtgctgtcat

SEQ ID NO: 694684 - DNA, 25 bp, Rattus norvegicus
tttgggaagctttatgtgctgtcat

SEQ ID NO: 694685 - DNA, 25 bp, Rattus norvegicus
tttgggaaggccaggagcatcctcc

SEQ ID NO: 694686 - DNA, 25 bp, Rattus norvegicus
tttgggaaggcctggagcatcctcc

SEQ ID NO: 694687 - DNA, 25 bp, Rattus norvegicus
tttgggaatcctagccaggccagaa

SEQ ID NO: 694688 - DNA, 25 bp, Rattus norvegicus
tttgggaatccttgccaggccagaa

SEQ ID NO: 694689 - DNA, 25 bp, Rattus norvegicus
tttgggaatctgcagcttggcatct

SEQ ID NO: 694690 - DNA, 25 bp, Rattus norvegicus
tttgggaatctggagcttggcatct

SEQ ID NO: 694691 - DNA, 25 bp, Rattus norvegicus
tttgggaccctactggtgaacgact

SEQ ID NO: 694692 - DNA, 25 bp, Rattus norvegicus
tttgggaccctagtggtgaacgact

SEQ ID NO: 694693 - DNA, 25 bp, Rattus norvegicus
tttgggaccgcaatttttccagatc

SEQ ID NO: 694694 - DNA, 25 bp, Rattus norvegicus
tttgggaccgcattttttccagatc

SEQ ID NO: 694695 - DNA, 25 bp, Rattus norvegicus
tttgggactatacctgggtaacacc

SEQ ID NO: 694696 - DNA, 25 bp, Rattus norvegicus
tttgggactatagctgggtaacacc

SEQ ID NO: 694697 - DNA, 25 bp, Rattus norvegicus
tttgggactgagacggagctcctac

SEQ ID NO: 694698 - DNA, 25 bp, Rattus norvegicus
tttgggactgagtcggagctcctac

SEQ ID NO: 694699 - DNA, 25 bp, Rattus norvegicus
tttgggactgtaaaagcctccgtca

SEQ ID NO: 694700 - DNA, 25 bp, Rattus norvegicus
tttgggactgtataagcctccgtca

SEQ ID NO: 694701 - DNA, 25 bp, Rattus norvegicus
tttgggactgttaccctggcgagac

SEQ ID NO: 694702 - DNA, 25 bp, Rattus norvegicus
tttgggactgtttccctggcgagac

SEQ ID NO: 694703 - DNA, 25 bp, Rattus norvegicus
tttgggagcctgaacaatctgtata

SEQ ID NO: 694704 - DNA, 25 bp, Rattus norvegicus
tttgggagcctgtacaatctgtata

SEQ ID NO: 694705 - DNA, 25 bp, Rattus norvegicus
tttgggatcaggaggcagctgttcc

SEQ ID NO: 694706 - DNA, 25 bp, Rattus norvegicus
tttgggatcaggtggcagctgttcc

SEQ ID NO: 694707 - DNA, 25 bp, Rattus norvegicus
tttgggatgtataacactggcgcgg

SEQ ID NO: 694708 - DNA, 25 bp, Rattus norvegicus
tttgggatgtattacactggcgcgg

SEQ ID NO: 694709 - DNA, 25 bp, Rattus norvegicus
tttgggattccaagcccaggcaaat

SEQ ID NO: 694710 - DNA, 25 bp, Rattus norvegicus
tttgggattccatgcccaggcaaat

SEQ ID NO: 694711 - DNA, 25 bp, Rattus norvegicus
tttgggcaacatctgaaagctattt

SEQ ID NO: 694712 - DNA, 25 bp, Rattus norvegicus
tttgggcaacatgtgaaagctattt

SEQ ID NO: 694713 - DNA, 25 bp, Rattus norvegicus
tttgggcacaggatgttgtactact

SEQ ID NO: 694714 - DNA, 25 bp, Rattus norvegicus
tttgggcacaggttgttgtactact

SEQ ID NO: 694715 - DNA, 25 bp, Rattus norvegicus
tttgggcacattcacaagtggctga

SEQ ID NO: 694716 - DNA, 25 bp, Rattus norvegicus
tttgggcacattctctattgatcag

SEQ ID NO: 694717 - DNA, 25 bp, Rattus norvegicus
tttgggcacattgacaagtggctga

SEQ ID NO: 694718 - DNA, 25 bp, Rattus norvegicus
tttgggcacattgtctattgatcag

SEQ ID NO: 694719 - DNA, 25 bp, Rattus norvegicus
tttgggcagccaatgaaattatcag

SEQ ID NO: 694720 - DNA, 25 bp, Rattus norvegicus
tttgggcagccattgaaattatcag

SEQ ID NO: 694721 - DNA, 25 bp, Rattus norvegicus
tttgggcatctacttctctgtaaga

SEQ ID NO: 694722 - DNA, 25 bp, Rattus norvegicus
tttgggcatctagttctctgtaaga

SEQ ID NO: 694723 - DNA, 25 bp, Rattus norvegicus
tttgggcatttcctagttccatgat

SEQ ID NO: 694724 - DNA, 25 bp, Rattus norvegicus
tttgggcatttcgtagttccatgat

SEQ ID NO: 694725 - DNA, 25 bp, Rattus norvegicus
tttgggccacgtactgaaggtacca

SEQ ID NO: 694726 - DNA, 25 bp, Rattus norvegicus
tttgggccacgttctgaaggtacca

SEQ ID NO: 694727 - DNA, 25 bp, Rattus norvegicus
tttgggccagcacaacgagactgta

SEQ ID NO: 694728 - DNA, 25 bp, Rattus norvegicus
tttgggccagcagaacgagactgta

SEQ ID NO: 694729 - DNA, 25 bp, Rattus norvegicus
tttgggccagttatggaccagagca

SEQ ID NO: 694730 - DNA, 25 bp, Rattus norvegicus
tttgggccagttttggaccagagca

SEQ ID NO: 694731 - DNA, 25 bp, Rattus norvegicus
tttgggccatgtctctcctcagtac

SEQ ID NO: 694732 - DNA, 25 bp, Rattus norvegicus
tttgggccatgtgtctcctcagtac

SEQ ID NO: 694733 - DNA, 25 bp, Rattus norvegicus
tttgggccattgcaagctgagtctc

SEQ ID NO: 694734 - DNA, 25 bp, Rattus norvegicus
tttgggccattggaagctgagtctc

SEQ ID NO: 694735 - DNA, 25 bp, Rattus norvegicus
tttgggccccatcctggaaagctgg

SEQ ID NO: 694736 - DNA, 25 bp, Rattus norvegicus
tttgggccccatgctggaaagctgg

SEQ ID NO: 694737 - DNA, 25 bp, Rattus norvegicus
tttgggccccttatgagatgaagta

SEQ ID NO: 694738 - DNA, 25 bp, Rattus norvegicus
tttgggccccttttgagatgaagta

SEQ ID NO: 694739 - DNA, 25 bp, Rattus norvegicus
tttgggccctccaggccgttcgtct

SEQ ID NO: 694740 - DNA, 25 bp, Rattus norvegicus
tttgggccctcctggccgttcgtct

SEQ ID NO: 694741 - DNA, 25 bp, Rattus norvegicus
tttgggcccttgctcagaaatatgt

SEQ ID NO: 694742 - DNA, 25 bp, Rattus norvegicus
tttgggcccttggtcagaaatatgt

SEQ ID NO: 694743 - DNA, 25 bp, Rattus norvegicus
tttgggccgggccctccgaaacacg

SEQ ID NO: 694744 - DNA, 25 bp, Rattus norvegicus
tttgggccgggcgctccgaaacacg

SEQ ID NO: 694745 - DNA, 25 bp, Rattus norvegicus
tttgggcctaatccattcctgtaat

SEQ ID NO: 694746 - DNA, 25 bp, Rattus norvegicus
tttgggcctaatgcattcctgtaat

SEQ ID NO: 694747 - DNA, 25 bp, Rattus norvegicus
tttgggcctcagatgtgcagatgta

SEQ ID NO: 694748 - DNA, 25 bp, Rattus norvegicus
tttgggcctcagttgtgcagatgta

SEQ ID NO: 694749 - DNA, 25 bp, Rattus norvegicus
tttgggcgagttacacacacatcag

SEQ ID NO: 694750 - DNA, 25 bp, Rattus norvegicus
tttgggcgagtttcacacacatcag

SEQ ID NO: 694751 - DNA, 25 bp, Rattus norvegicus
tttgggcgatctacttggctgacag

SEQ ID NO: 694752 - DNA, 25 bp, Rattus norvegicus
tttgggcgatcttcttggctgacag

SEQ ID NO: 694753 - DNA, 25 bp, Rattus norvegicus
tttgggctagccataaattcatggt

SEQ ID NO: 694754 - DNA, 25 bp, Rattus norvegicus
tttgggctagccttaaattcatggt

SEQ ID NO: 694755 - DNA, 25 bp, Rattus norvegicus
tttgggctcaatactgcaactttcc

SEQ ID NO: 694756 - DNA, 25 bp, Rattus norvegicus
tttgggctcaattctgcaactttcc

SEQ ID NO: 694757 - DNA, 25 bp, Rattus norvegicus
tttgggctcagcaattccactgtaa

SEQ ID NO: 694758 - DNA, 25 bp, Rattus norvegicus
tttgggctcagctattccactgtaa

SEQ ID NO: 694759 - DNA, 25 bp, Rattus norvegicus
tttgggctctatcggcaaaccacag

SEQ ID NO: 694760 - DNA, 25 bp, Rattus norvegicus
tttgggctctatgggcaaaccacag

SEQ ID NO: 694761 - DNA, 25 bp, Rattus norvegicus
tttgggctgagaactaggtcctggt

SEQ ID NO: 694762 - DNA, 25 bp, Rattus norvegicus
tttgggctgagatctaggtcctggt

SEQ ID NO: 694763 - DNA, 25 bp, Rattus norvegicus
tttgggctggttcttcatcgatgac

SEQ ID NO: 694764 - DNA, 25 bp, Rattus norvegicus
tttgggctggttgttcatcgatgac

SEQ ID NO: 694765 - DNA, 25 bp, Rattus norvegicus
tttgggcttatgcagtgctaacttt

SEQ ID NO: 694766 - DNA, 25 bp, Rattus norvegicus
tttgggcttatggagtgctaacttt

SEQ ID NO: 694767 - DNA, 25 bp, Rattus norvegicus
tttgggcttcggcagacttacacat

SEQ ID NO: 694768 - DNA, 25 bp, Rattus norvegicus
tttgggcttcgggagacttacacat

SEQ ID NO: 694769 - DNA, 25 bp, Rattus norvegicus
tttgggctttcaacctcctgagaag

SEQ ID NO: 694770 - DNA, 25 bp, Rattus norvegicus
tttgggctttcatcctcctgagaag

SEQ ID NO: 694771 - DNA, 25 bp, Rattus norvegicus
tttgggtacatcagctgtgtgggaa

SEQ ID NO: 694772 - DNA, 25 bp, Rattus norvegicus
tttgggtacatctgctgtgtgggaa

SEQ ID NO: 694773 - DNA, 25 bp, Rattus norvegicus
tttgggtacatgagacaggcttgac

SEQ ID NO: 694774 - DNA, 25 bp, Rattus norvegicus
tttgggtacatgtgacaggcttgac

SEQ ID NO: 694775 - DNA, 25 bp, Rattus norvegicus
tttgggtaccaaatcgcatagcgag

SEQ ID NO: 694776 - DNA, 25 bp, Rattus norvegicus
tttgggtaccaattcgcatagcgag

SEQ ID NO: 694777 - DNA, 25 bp, Rattus norvegicus
tttgggtagtgtaataggtcatata

SEQ ID NO: 694778 - DNA, 25 bp, Rattus norvegicus
tttgggtagtgttataggtcatata

SEQ ID NO: 694779 - DNA, 25 bp, Rattus norvegicus
tttgggtatcaaaatgcagctgtca

SEQ ID NO: 694780 - DNA, 25 bp, Rattus norvegicus
tttgggtatcaatatgcagctgtca

SEQ ID NO: 694781 - DNA, 25 bp, Rattus norvegicus
tttgggtcacctctctagaagtctt

SEQ ID NO: 694782 - DNA, 25 bp, Rattus norvegicus
tttgggtcacctgtctagaagtctt

SEQ ID NO: 694783 - DNA, 25 bp, Rattus norvegicus
tttgggtcactcacacagtgctgaa

SEQ ID NO: 694784 - DNA, 25 bp, Rattus norvegicus
tttgggtcactctcacagtgctgaa

SEQ ID NO: 694785 - DNA, 25 bp, Rattus norvegicus
tttgggtccaccagggctgctgagt

SEQ ID NO: 694786 - DNA, 25 bp, Rattus norvegicus
tttgggtccacctgggctgctgagt

SEQ ID NO: 694787 - DNA, 25 bp, Rattus norvegicus
tttgggtcccaactctgagtcagag

SEQ ID NO: 694788 - DNA, 25 bp, Rattus norvegicus
tttgggtcccaagtctgagtcagag

SEQ ID NO: 694789 - DNA, 25 bp, Rattus norvegicus
tttgggtccctcaggaggctctgat

SEQ ID NO: 694790 - DNA, 25 bp, Rattus norvegicus
tttgggtccctctggaggctctgat

SEQ ID NO: 694791 - DNA, 25 bp, Rattus norvegicus
tttgggtcctggagcaaagagtgct

SEQ ID NO: 694792 - DNA, 25 bp, Rattus norvegicus
tttgggtcctggtgcaaagagtgct

SEQ ID NO: 694793 - DNA, 25 bp, Rattus norvegicus
tttgggtctaatactgtgagcctac

SEQ ID NO: 694794 - DNA, 25 bp, Rattus norvegicus
tttgggtctaattctgtgagcctac

SEQ ID NO: 694795 - DNA, 25 bp, Rattus norvegicus
tttgggtctcaaacgggttgtcact

SEQ ID NO: 694796 - DNA, 25 bp, Rattus norvegicus
tttgggtctcaatcgggttgtcact

SEQ ID NO: 694797 - DNA, 25 bp, Rattus norvegicus
tttgggtctggtaaagtcctcctca

SEQ ID NO: 694798 - DNA, 25 bp, Rattus norvegicus
tttgggtctggttaagtcctcctca

SEQ ID NO: 694799 - DNA, 25 bp, Rattus norvegicus
tttgggtcttaactactgaaggcat

SEQ ID NO: 694800 - DNA, 25 bp, Rattus norvegicus
tttgggtcttaagtactgaaggcat

SEQ ID NO: 694801 - DNA, 25 bp, Rattus norvegicus
tttgggtgaatgatcctcatctcag

SEQ ID NO: 694802 - DNA, 25 bp, Rattus norvegicus
tttgggtgaatgttcctcatctcag

SEQ ID NO: 694803 - DNA, 25 bp, Rattus norvegicus
tttgggtgccccagcataagcaggt

SEQ ID NO: 694804 - DNA, 25 bp, Rattus norvegicus
tttgggtgcccctgcataagcaggt

SEQ ID NO: 694805 - DNA, 25 bp, Rattus norvegicus
tttgggtggctcacccttaggacac

SEQ ID NO: 694806 - DNA, 25 bp, Rattus norvegicus
tttgggtggctctcccttaggacac

SEQ ID NO: 694807 - DNA, 25 bp, Rattus norvegicus
tttgggttatcacaacctcatcccc

SEQ ID NO: 694808 - DNA, 25 bp, Rattus norvegicus
tttgggttatcagaacctcatcccc

SEQ ID NO: 694809 - DNA, 25 bp, Rattus norvegicus
tttgggttatctcccatcccattaa

SEQ ID NO: 694810 - DNA, 25 bp, Rattus norvegicus
tttgggttatctgccatcccattaa

SEQ ID NO: 694811 - DNA, 25 bp, Rattus norvegicus
tttgggttcaatcactagtactgca

SEQ ID NO: 694812 - DNA, 25 bp, Rattus norvegicus
tttgggttcaatgactagtactgca

SEQ ID NO: 694813 - DNA, 25 bp, Rattus norvegicus
tttgggttcattagctgttttgcct

SEQ ID NO: 694814 - DNA, 25 bp, Rattus norvegicus
tttgggttcatttgctgttttgcct

SEQ ID NO: 694815 - DNA, 25 bp, Rattus norvegicus
tttgggttttccaggcctggacctg

SEQ ID NO: 694816 - DNA, 25 bp, Rattus norvegicus
tttgggttttcctggcctggacctg

SEQ ID NO: 694817 - DNA, 25 bp, Rattus norvegicus
tttggtaaatctcccgtccatctgg

SEQ ID NO: 694818 - DNA, 25 bp, Rattus norvegicus
tttggtaaatctctgatctgcccag

SEQ ID NO: 694819 - DNA, 25 bp, Rattus norvegicus
tttggtaaatctgccgtccatctgg

SEQ ID NO: 694820 - DNA, 25 bp, Rattus norvegicus
tttggtaaatctgtgatctgcccag

SEQ ID NO: 694821 - DNA, 25 bp, Rattus norvegicus
tttggtaacaagcttactttccatg

SEQ ID NO: 694822 - DNA, 25 bp, Rattus norvegicus
tttggtaacaaggttactttccatg

SEQ ID NO: 694823 - DNA, 25 bp, Rattus norvegicus
tttggtaagttcatcctcacttctc

SEQ ID NO: 694824 - DNA, 25 bp, Rattus norvegicus
tttggtaagttcttcctcacttctc

SEQ ID NO: 694825 - DNA, 25 bp, Rattus norvegicus
tttggtactaacactggtcaccctt

SEQ ID NO: 694826 - DNA, 25 bp, Rattus norvegicus
tttggtactaactctggtcaccctt

SEQ ID NO: 694827 - DNA, 25 bp, Rattus norvegicus
tttggtagagtccaagctccccggt

SEQ ID NO: 694828 - DNA, 25 bp, Rattus norvegicus
tttggtagagtcgaagctccccggt

SEQ ID NO: 694829 - DNA, 25 bp, Rattus norvegicus
tttggtagcagaagagccctgattc

SEQ ID NO: 694830 - DNA, 25 bp, Rattus norvegicus
tttggtagcagatgagccctgattc

SEQ ID NO: 694831 - DNA, 25 bp, Rattus norvegicus
tttggtagtaacctgaccccacagc

SEQ ID NO: 694832 - DNA, 25 bp, Rattus norvegicus
tttggtagtaacgtgaccccacagc

SEQ ID NO: 694833 - DNA, 25 bp, Rattus norvegicus
tttggtagtcatagctgtctgccat

SEQ ID NO: 694834 - DNA, 25 bp, Rattus norvegicus
tttggtagtcattgctgtctgccat

SEQ ID NO: 694835 - DNA, 25 bp, Rattus norvegicus
tttggtagtctaacatgatggtatg

SEQ ID NO: 694836 - DNA, 25 bp, Rattus norvegicus
tttggtagtctatcatgatggtatg

SEQ ID NO: 694837 - DNA, 25 bp, Rattus norvegicus
tttggtatcttgctcaggaattagt

SEQ ID NO: 694838 - DNA, 25 bp, Rattus norvegicus
tttggtatcttggtcaggaattagt

SEQ ID NO: 694839 - DNA, 25 bp, Rattus norvegicus
tttggtatgaggcaagtacccctaa

SEQ ID NO: 694840 - DNA, 25 bp, Rattus norvegicus
tttggtatgagggaagtacccctaa

SEQ ID NO: 694841 - DNA, 25 bp, Rattus norvegicus
tttggtattcacacagctccataac

SEQ ID NO: 694842 - DNA, 25 bp, Rattus norvegicus
tttggtattcactcagctccataac

SEQ ID NO: 694843 - DNA, 25 bp, Rattus norvegicus
tttggtcatagccatcttctcatct

SEQ ID NO: 694844 - DNA, 25 bp, Rattus norvegicus
tttggtcatagcgatcttctcatct

SEQ ID NO: 694845 - DNA, 25 bp, Rattus norvegicus
tttggtcatcgtctatctcattgcc

SEQ ID NO: 694846 - DNA, 25 bp, Rattus norvegicus
tttggtcatcgtgtatctcattgcc

SEQ ID NO: 694847 - DNA, 25 bp, Rattus norvegicus
tttggtcattccattctgcagccag

SEQ ID NO: 694848 - DNA, 25 bp, Rattus norvegicus
tttggtcattcctttctgcagccag

SEQ ID NO: 694849 - DNA, 25 bp, Rattus norvegicus
tttggtcattgcaacgatcttgatc

SEQ ID NO: 694850 - DNA, 25 bp, Rattus norvegicus
tttggtcattgctacgatcttgatc

SEQ ID NO: 694851 - DNA, 25 bp, Rattus norvegicus
tttggtcattttcagttcctcacac

SEQ ID NO: 694852 - DNA, 25 bp, Rattus norvegicus
tttggtcattttgagttcctcacac

SEQ ID NO: 694853 - DNA, 25 bp, Rattus norvegicus
tttggtccacacatctatctgtagc

SEQ ID NO: 694854 - DNA, 25 bp, Rattus norvegicus
tttggtccacacttctatctgtagc

SEQ ID NO: 694855 - DNA, 25 bp, Rattus norvegicus
tttggtccacagagcaggctgatca

SEQ ID NO: 694856 - DNA, 25 bp, Rattus norvegicus
tttggtccacagtgcaggctgatca

SEQ ID NO: 694857 - DNA, 25 bp, Rattus norvegicus
tttggtcccatcacatgaaaccagc

SEQ ID NO: 694858 - DNA, 25 bp, Rattus norvegicus
tttggtcccatctcatgaaaccagc

SEQ ID NO: 694859 - DNA, 25 bp, Rattus norvegicus
tttggtcccatgacagaatgcagat

SEQ ID NO: 694860 - DNA, 25 bp, Rattus norvegicus
tttggtcccatgtcagaatgcagat

SEQ ID NO: 694861 - DNA, 25 bp, Rattus norvegicus
tttggtccctaaactgacatgctgt

SEQ ID NO: 694862 - DNA, 25 bp, Rattus norvegicus
tttggtccctaatctgacatgctgt

SEQ ID NO: 694863 - DNA, 25 bp, Rattus norvegicus
tttggtccctagctggtttgaaatc

SEQ ID NO: 694864 - DNA, 25 bp, Rattus norvegicus
tttggtccctaggtggtttgaaatc

SEQ ID NO: 694865 - DNA, 25 bp, Rattus norvegicus
tttggtcctactacggtgctcctgg

SEQ ID NO: 694866 - DNA, 25 bp, Rattus norvegicus
tttggtcctacttcggtgctcctgg

SEQ ID NO: 694867 - DNA, 25 bp, Rattus norvegicus
tttggtcctatgacagagcagcggt

SEQ ID NO: 694868 - DNA, 25 bp, Rattus norvegicus
tttggtcctatgtcagagcagcggt

SEQ ID NO: 694869 - DNA, 25 bp, Rattus norvegicus
tttggtcctgccagagggttctaaa

SEQ ID NO: 694870 - DNA, 25 bp, Rattus norvegicus
tttggtcctgcctgagggttctaaa

SEQ ID NO: 694871 - DNA, 25 bp, Rattus norvegicus
tttggtcctgggaatagcacctggg

SEQ ID NO: 694872 - DNA, 25 bp, Rattus norvegicus
tttggtcctgggtatagcacctggg

SEQ ID NO: 694873 - DNA, 25 bp, Rattus norvegicus
tttggtccttccacaacggaaacat

SEQ ID NO: 694874 - DNA, 25 bp, Rattus norvegicus
tttggtccttcctcaacggaaacat

SEQ ID NO: 694875 - DNA, 25 bp, Rattus norvegicus
tttggtcgcagccttgtttctcagc

SEQ ID NO: 694876 - DNA, 25 bp, Rattus norvegicus
tttggtcgcagcgttgtttctcagc

SEQ ID NO: 694877 - DNA, 25 bp, Rattus norvegicus
tttggtctctggagcatcttactca

SEQ ID NO: 694878 - DNA, 25 bp, Rattus norvegicus
tttggtctctggtgcatcttactca

SEQ ID NO: 694879 - DNA, 25 bp, Rattus norvegicus
tttggtctgcatcccattgtgagaa

SEQ ID NO: 694880 - DNA, 25 bp, Rattus norvegicus
tttggtctgcatgccattgtgagaa

SEQ ID NO: 694881 - DNA, 25 bp, Rattus norvegicus
tttggtctggagagtggacgcccat

SEQ ID NO: 694882 - DNA, 25 bp, Rattus norvegicus
tttggtctggagtgtggacgcccat

SEQ ID NO: 694883 - DNA, 25 bp, Rattus norvegicus
tttggtctttgtatcccagcctgtg

SEQ ID NO: 694884 - DNA, 25 bp, Rattus norvegicus
tttggtctttgtttcccagcctgtg

SEQ ID NO: 694885 - DNA, 25 bp, Rattus norvegicus
tttggtgaaccgaagtcagcgttgt

SEQ ID NO: 694886 - DNA, 25 bp, Rattus norvegicus
tttggtgaaccgtagtcagcgttgt

SEQ ID NO: 694887 - DNA, 25 bp, Rattus norvegicus
tttggtgaagccacggtacccactc

SEQ ID NO: 694888 - DNA, 25 bp, Rattus norvegicus
tttggtgaagcctcggtacccactc

SEQ ID NO: 694889 - DNA, 25 bp, Rattus norvegicus
tttggtgacaagctctagacatctg

SEQ ID NO: 694890 - DNA, 25 bp, Rattus norvegicus
tttggtgacaaggtctagacatctg

SEQ ID NO: 694891 - DNA, 25 bp, Rattus norvegicus
tttggtgacaatcatctctagggtt

SEQ ID NO: 694892 - DNA, 25 bp, Rattus norvegicus
tttggtgacaatgatctctagggtt

SEQ ID NO: 694893 - DNA, 25 bp, Rattus norvegicus
tttggtgacatcaccgaggctgatg

SEQ ID NO: 694894 - DNA, 25 bp, Rattus norvegicus
tttggtgacatctccgaggctgatg

SEQ ID NO: 694895 - DNA, 25 bp, Rattus norvegicus
tttggtgactctcactctgcagagt

SEQ ID NO: 694896 - DNA, 25 bp, Rattus norvegicus
tttggtgactctgactctgcagagt

SEQ ID NO: 694897 - DNA, 25 bp, Rattus norvegicus
tttggtgactgtatagctctaagca

SEQ ID NO: 694898 - DNA, 25 bp, Rattus norvegicus
tttggtgactgtttagctctaagca

SEQ ID NO: 694899 - DNA, 25 bp, Rattus norvegicus
tttggtgagaccatgccctgaggaa

SEQ ID NO: 694900 - DNA, 25 bp, Rattus norvegicus
tttggtgagaccttgccctgaggaa

SEQ ID NO: 694901 - DNA, 25 bp, Rattus norvegicus
tttggtgagagaacaacggctgcct

SEQ ID NO: 694902 - DNA, 25 bp, Rattus norvegicus
tttggtgagagatcaacggctgcct

SEQ ID NO: 694903 - DNA, 25 bp, Rattus norvegicus
tttggtgagtggaccagagctctga

SEQ ID NO: 694904 - DNA, 25 bp, Rattus norvegicus
tttggtgagtggtccagagctctga

SEQ ID NO: 694905 - DNA, 25 bp, Rattus norvegicus
tttggtgcccaaagctgagcctgta

SEQ ID NO: 694906 - DNA, 25 bp, Rattus norvegicus
tttggtgcccaatgctgagcctgta

SEQ ID NO: 694907 - DNA, 25 bp, Rattus norvegicus
tttggtgcccagctgtcacacacag

SEQ ID NO: 694908 - DNA, 25 bp, Rattus norvegicus
tttggtgcccaggtgtcacacacag

SEQ ID NO: 694909 - DNA, 25 bp, Rattus norvegicus
tttggtgccgagaatccgggacaca

SEQ ID NO: 694910 - DNA, 25 bp, Rattus norvegicus
tttggtgccgagtatccgggacaca

SEQ ID NO: 694911 - DNA, 25 bp, Rattus norvegicus
tttggtgcctcaaggctgcctgagt

SEQ ID NO: 694912 - DNA, 25 bp, Rattus norvegicus
tttggtgcctcatggctgcctgagt

SEQ ID NO: 694913 - DNA, 25 bp, Rattus norvegicus
tttggtggacacaggcattggcatg

SEQ ID NO: 694914 - DNA, 25 bp, Rattus norvegicus
tttggtggacactggcattggcatg

SEQ ID NO: 694915 - DNA, 25 bp, Rattus norvegicus
tttggtggactcatcagggtattca

SEQ ID NO: 694916 - DNA, 25 bp, Rattus norvegicus
tttggtggactcttcagggtattca

SEQ ID NO: 694917 - DNA, 25 bp, Rattus norvegicus
tttggtggccctagtgctcaacgta

SEQ ID NO: 694918 - DNA, 25 bp, Rattus norvegicus
tttggtggccctctataccattgtc

SEQ ID NO: 694919 - DNA, 25 bp, Rattus norvegicus
tttggtggccctgtataccattgtc

SEQ ID NO: 694920 - DNA, 25 bp, Rattus norvegicus
tttggtggcccttgtgctcaacgta

SEQ ID NO: 694921 - DNA, 25 bp, Rattus norvegicus
tttggtggctagaggccgccacaat

SEQ ID NO: 694922 - DNA, 25 bp, Rattus norvegicus
tttggtggctagtggccgccacaat

SEQ ID NO: 694923 - DNA, 25 bp, Rattus norvegicus
tttggtggctgacgctgacctgccc

SEQ ID NO: 694924 - DNA, 25 bp, Rattus norvegicus
tttggtggctgaggctgacctgccc

SEQ ID NO: 694925 - DNA, 25 bp, Rattus norvegicus
tttggtgggcctccagttgccccat

SEQ ID NO: 694926 - DNA, 25 bp, Rattus norvegicus
tttggtgggcctgcagttgccccat

SEQ ID NO: 694927 - DNA, 25 bp, Rattus norvegicus
tttggtgtgaatacactgcctcctt

SEQ ID NO: 694928 - DNA, 25 bp, Rattus norvegicus
tttggtgtgaattcactgcctcctt

SEQ ID NO: 694929 - DNA, 25 bp, Rattus norvegicus
tttggtgtggagcatttctcatcac

SEQ ID NO: 694930 - DNA, 25 bp, Rattus norvegicus
tttggtgtggaggatttctcatcac

SEQ ID NO: 694931 - DNA, 25 bp, Rattus norvegicus
tttggtgttcacctctgacaatgcc

SEQ ID NO: 694932 - DNA, 25 bp, Rattus norvegicus
tttggtgttcacgtctgacaatgcc

SEQ ID NO: 694933 - DNA, 25 bp, Rattus norvegicus
tttggttaccagaacccatatccac

SEQ ID NO: 694934 - DNA, 25 bp, Rattus norvegicus
tttggttaccagtacccatatccac

SEQ ID NO: 694935 - DNA, 25 bp, Rattus norvegicus
tttggttagcatattccagtgtcta

SEQ ID NO: 694936 - DNA, 25 bp, Rattus norvegicus
tttggttagcattttccagtgtcta

SEQ ID NO: 694937 - DNA, 25 bp, Rattus norvegicus
tttggttcagccagaactctgctgt

SEQ ID NO: 694938 - DNA, 25 bp, Rattus norvegicus
tttggttcagcctgaactctgctgt

SEQ ID NO: 694939 - DNA, 25 bp, Rattus norvegicus
tttggttcagttacaacatcatgat

SEQ ID NO: 694940 - DNA, 25 bp, Rattus norvegicus
tttggttcagtttcaacatcatgat

SEQ ID NO: 694941 - DNA, 25 bp, Rattus norvegicus
tttggttcatccaggtacactcagc

SEQ ID NO: 694942 - DNA, 25 bp, Rattus norvegicus
tttggttcatcctggtacactcagc

SEQ ID NO: 694943 - DNA, 25 bp, Rattus norvegicus
tttggttccactagaccagacctta

SEQ ID NO: 694944 - DNA, 25 bp, Rattus norvegicus
tttggttccacttgaccagacctta

SEQ ID NO: 694945 - DNA, 25 bp, Rattus norvegicus
tttggttcccaacagttgtttagag

SEQ ID NO: 694946 - DNA, 25 bp, Rattus norvegicus
tttggttcccaaccctgaactggat

SEQ ID NO: 694947 - DNA, 25 bp, Rattus norvegicus
tttggttcccaagagttgtttagag

SEQ ID NO: 694948 - DNA, 25 bp, Rattus norvegicus
tttggttcccaagcctgaactggat

SEQ ID NO: 694949 - DNA, 25 bp, Rattus norvegicus
tttggttcccacaatgtagactact

SEQ ID NO: 694950 - DNA, 25 bp, Rattus norvegicus
tttggttcccaccatcttaaagatg

SEQ ID NO: 694951 - DNA, 25 bp, Rattus norvegicus
tttggttcccacgatcttaaagatg

SEQ ID NO: 694952 - DNA, 25 bp, Rattus norvegicus
tttggttcccactatgtagactact

SEQ ID NO: 694953 - DNA, 25 bp, Rattus norvegicus
tttggttcccagaactcttgtgagc

SEQ ID NO: 694954 - DNA, 25 bp, Rattus norvegicus
tttggttcccagtactcttgtgagc

SEQ ID NO: 694955 - DNA, 25 bp, Rattus norvegicus
tttggttcctaaccacccatacaaa

SEQ ID NO: 694956 - DNA, 25 bp, Rattus norvegicus
tttggttcctaagcacccatacaaa

SEQ ID NO: 694957 - DNA, 25 bp, Rattus norvegicus
tttggttcctgtccacagcccctaa

SEQ ID NO: 694958 - DNA, 25 bp, Rattus norvegicus
tttggttcctgtgcacagcccctaa

SEQ ID NO: 694959 - DNA, 25 bp, Rattus norvegicus
tttggttccttcagcagttctgtct

SEQ ID NO: 694960 - DNA, 25 bp, Rattus norvegicus
tttggttccttctgcagttctgtct

SEQ ID NO: 694961 - DNA, 25 bp, Rattus norvegicus
tttggttcgcgtaactgatgactct

SEQ ID NO: 694962 - DNA, 25 bp, Rattus norvegicus
tttggttcgcgttactgatgactct

SEQ ID NO: 694963 - DNA, 25 bp, Rattus norvegicus
tttggttctggtagctaagcagcca

SEQ ID NO: 694964 - DNA, 25 bp, Rattus norvegicus
tttggttctggttgctaagcagcca

SEQ ID NO: 694965 - DNA, 25 bp, Rattus norvegicus
tttggttcttctactcgaacattgg

SEQ ID NO: 694966 - DNA, 25 bp, Rattus norvegicus
tttggttcttcttctcgaacattgg

SEQ ID NO: 694967 - DNA, 25 bp, Rattus norvegicus
tttggttgaatcactcctggttggt

SEQ ID NO: 694968 - DNA, 25 bp, Rattus norvegicus
tttggttgaatctctcctggttggt

SEQ ID NO: 694969 - DNA, 25 bp, Rattus norvegicus
tttggttgaattatcctcctatgga

SEQ ID NO: 694970 - DNA, 25 bp, Rattus norvegicus
tttggttgaattttcctcctatgga

SEQ ID NO: 694971 - DNA, 25 bp, Rattus norvegicus
tttggttgctgcatgtgtctcccag

SEQ ID NO: 694972 - DNA, 25 bp, Rattus norvegicus
tttggttgctgcttgtgtctcccag

SEQ ID NO: 694973 - DNA, 25 bp, Rattus norvegicus
tttggttggtatatttgtctcctca

SEQ ID NO: 694974 - DNA, 25 bp, Rattus norvegicus
tttggttggtatttttgtctcctca

SEQ ID NO: 694975 - DNA, 25 bp, Rattus norvegicus
tttggttggtgaacccagactctga

SEQ ID NO: 694976 - DNA, 25 bp, Rattus norvegicus
tttggttggtgatcccagactctga

SEQ ID NO: 694977 - DNA, 25 bp, Rattus norvegicus
tttggttgtcaactgtttctgcatg

SEQ ID NO: 694978 - DNA, 25 bp, Rattus norvegicus
tttggttgtcaagtgtttctgcatg

SEQ ID NO: 694979 - DNA, 25 bp, Rattus norvegicus
tttggttgtgttacttggttctatt

SEQ ID NO: 694980 - DNA, 25 bp, Rattus norvegicus
tttggttgtgtttcttggttctatt

SEQ ID NO: 694981 - DNA, 25 bp, Rattus norvegicus
tttggtttacacatcaagcctcgca

SEQ ID NO: 694982 - DNA, 25 bp, Rattus norvegicus
tttggtttacacttcaagcctcgca

SEQ ID NO: 694983 - DNA, 25 bp, Rattus norvegicus
tttggtttacatctgatttgctctt

SEQ ID NO: 694984 - DNA, 25 bp, Rattus norvegicus
tttggtttacatgtgatttgctctt

SEQ ID NO: 694985 - DNA, 25 bp, Rattus norvegicus
tttggtttagaacagtcaaactcct

SEQ ID NO: 694986 - DNA, 25 bp, Rattus norvegicus
tttggtttagaagagtcaaactcct

SEQ ID NO: 694987 - DNA, 25 bp, Rattus norvegicus
tttggtttccatcgtcacctggtaa

SEQ ID NO: 694988 - DNA, 25 bp, Rattus norvegicus
tttggtttccatggtcacctggtaa

SEQ ID NO: 694989 - DNA, 25 bp, Rattus norvegicus
tttggtttccgtagagagtacatct

SEQ ID NO: 694990 - DNA, 25 bp, Rattus norvegicus
tttggtttccgttgagagtacatct

SEQ ID NO: 694991 - DNA, 25 bp, Rattus norvegicus
tttggtttcctgcacctgcttaaag

SEQ ID NO: 694992 - DNA, 25 bp, Rattus norvegicus
tttggtttcctggacctgcttaaag

SEQ ID NO: 694993 - DNA, 25 bp, Rattus norvegicus
tttggtttctaaatcactgcctatt

SEQ ID NO: 694994 - DNA, 25 bp, Rattus norvegicus
tttggtttctaattcactgcctatt

SEQ ID NO: 694995 - DNA, 25 bp, Rattus norvegicus
tttggtttgaccagtgagcatgctt

SEQ ID NO: 694996 - DNA, 25 bp, Rattus norvegicus
tttggtttgacctgtgagcatgctt

SEQ ID NO: 694997 - DNA, 25 bp, Rattus norvegicus
tttggtttgcatctctaacgatgta

SEQ ID NO: 694998 - DNA, 25 bp, Rattus norvegicus
tttggtttgcatgtctaacgatgta

SEQ ID NO: 694999 - DNA, 25 bp, Rattus norvegicus
tttggtttggctatcttacttcaca

SEQ ID NO: 695000 - DNA, 25 bp, Rattus norvegicus
tttggtttggctttcttacttcaca

SEQ ID NO: 695001 - DNA, 25 bp, Rattus norvegicus
tttggttttaggctccattggcttc

SEQ ID NO: 695002 - DNA, 25 bp, Rattus norvegicus
tttggttttagggtccattggcttc

SEQ ID NO: 695003 - DNA, 25 bp, Rattus norvegicus
tttggttttattcatgtcactgtaa

SEQ ID NO: 695004 - DNA, 25 bp, Rattus norvegicus
tttggttttattgatgtcactgtaa

SEQ ID NO: 695005 - DNA, 25 bp, Rattus norvegicus
tttggttttcacaagttttgcttct

SEQ ID NO: 695006 - DNA, 25 bp, Rattus norvegicus
tttggttttcactagttttgcttct

SEQ ID NO: 695007 - DNA, 25 bp, Rattus norvegicus
tttggttttgctatgactagcaata

SEQ ID NO: 695008 - DNA, 25 bp, Rattus norvegicus
tttggttttgctttgactagcaata

SEQ ID NO: 695009 - DNA, 25 bp, Rattus norvegicus
tttgtaaaagcccaggccagtttgt

SEQ ID NO: 695010 - DNA, 25 bp, Rattus norvegicus
tttgtaaaagccgaggccagtttgt

SEQ ID NO: 695011 - DNA, 25 bp, Rattus norvegicus
tttgtaaaagtcaggctcggcagca

SEQ ID NO: 695012 - DNA, 25 bp, Rattus norvegicus
tttgtaaaagtctggctcggcagca

SEQ ID NO: 695013 - DNA, 25 bp, Rattus norvegicus
tttgtaaaccggcttgacaggaatg

SEQ ID NO: 695014 - DNA, 25 bp, Rattus norvegicus
tttgtaaaccgggttgacaggaatg

SEQ ID NO: 695015 - DNA, 25 bp, Rattus norvegicus
tttgtaaacctcagcttgtgagata

SEQ ID NO: 695016 - DNA, 25 bp, Rattus norvegicus
tttgtaaacctctgcttgtgagata

SEQ ID NO: 695017 - DNA, 25 bp, Rattus norvegicus
tttgtaaaccttagggctgtcgtga

SEQ ID NO: 695018 - DNA, 25 bp, Rattus norvegicus
tttgtaaacctttgggctgtcgtga

SEQ ID NO: 695019 - DNA, 25 bp, Rattus norvegicus
tttgtaaagcctagctccatagcct

SEQ ID NO: 695020 - DNA, 25 bp, Rattus norvegicus
tttgtaaagccttgctccatagcct

SEQ ID NO: 695021 - DNA, 25 bp, Rattus norvegicus
tttgtaaagtgcctgctctgcctgc

SEQ ID NO: 695022 - DNA, 25 bp, Rattus norvegicus
tttgtaaagtgcgtgctctgcctgc

SEQ ID NO: 695023 - DNA, 25 bp, Rattus norvegicus
tttgtaaatatacctgtctcccttt

SEQ ID NO: 695024 - DNA, 25 bp, Rattus norvegicus
tttgtaaatatagctgtctcccttt

SEQ ID NO: 695025 - DNA, 25 bp, Rattus norvegicus
tttgtaacagctatccagggacact

SEQ ID NO: 695026 - DNA, 25 bp, Rattus norvegicus
tttgtaacagctttccagggacact

SEQ ID NO: 695027 - DNA, 25 bp, Rattus norvegicus
tttgtaaccttcatcttgcacagac

SEQ ID NO: 695028 - DNA, 25 bp, Rattus norvegicus
tttgtaaccttcttcttgcacagac

SEQ ID NO: 695029 - DNA, 25 bp, Rattus norvegicus
tttgtaactaggctttctcatccgc

SEQ ID NO: 695030 - DNA, 25 bp, Rattus norvegicus
tttgtaactagggtttctcatccgc

SEQ ID NO: 695031 - DNA, 25 bp, Rattus norvegicus
tttgtaatcgagacagcccatcttg

SEQ ID NO: 695032 - DNA, 25 bp, Rattus norvegicus
tttgtaatcgagtcagcccatcttg

SEQ ID NO: 695033 - DNA, 25 bp, Rattus norvegicus
tttgtaatgcgtatagtcccttata

SEQ ID NO: 695034 - DNA, 25 bp, Rattus norvegicus
tttgtaatgcgtttagtcccttata

SEQ ID NO: 695035 - DNA, 25 bp, Rattus norvegicus
tttgtaatgcttattcacctctcgg

SEQ ID NO: 695036 - DNA, 25 bp, Rattus norvegicus
tttgtaatgctttttcacctctcgg

SEQ ID NO: 695037 - DNA, 25 bp, Rattus norvegicus
tttgtaatgtctccctgattcacca

SEQ ID NO: 695038 - DNA, 25 bp, Rattus norvegicus
tttgtaatgtctgcctgattcacca

SEQ ID NO: 695039 - DNA, 25 bp, Rattus norvegicus
tttgtaattttcaactccgattatg

SEQ ID NO: 695040 - DNA, 25 bp, Rattus norvegicus
tttgtaattttctactccgattatg

SEQ ID NO: 695041 - DNA, 25 bp, Rattus norvegicus
tttgtacacgaacctgcaagttact

SEQ ID NO: 695042 - DNA, 25 bp, Rattus norvegicus
tttgtacacgaagctgcaagttact

SEQ ID NO: 695043 - DNA, 25 bp, Rattus norvegicus
tttgtacagagacaccttggcacct

SEQ ID NO: 695044 - DNA, 25 bp, Rattus norvegicus
tttgtacagagagaccttggcacct

SEQ ID NO: 695045 - DNA, 25 bp, Rattus norvegicus
tttgtacagtctcagttgcttgctc

SEQ ID NO: 695046 - DNA, 25 bp, Rattus norvegicus
tttgtacagtctgagttgcttgctc

SEQ ID NO: 695047 - DNA, 25 bp, Rattus norvegicus
tttgtacagtttcccaatccctcaa

SEQ ID NO: 695048 - DNA, 25 bp, Rattus norvegicus
tttgtacagtttgccaatccctcaa

SEQ ID NO: 695049 - DNA, 25 bp, Rattus norvegicus
tttgtacatcttatggcgagtggcc

SEQ ID NO: 695050 - DNA, 25 bp, Rattus norvegicus
tttgtacatcttttggcgagtggcc

SEQ ID NO: 695051 - DNA, 25 bp, Rattus norvegicus
tttgtacattctctactcttaagtg

SEQ ID NO: 695052 - DNA, 25 bp, Rattus norvegicus
tttgtacattctgtactcttaagtg

SEQ ID NO: 695053 - DNA, 25 bp, Rattus norvegicus
tttgtacattgtcctttccttcctt

SEQ ID NO: 695054 - DNA, 25 bp, Rattus norvegicus
tttgtacattgtgctttccttcctt

SEQ ID NO: 695055 - DNA, 25 bp, Rattus norvegicus
tttgtaccaatcacgctgaagcgtc

SEQ ID NO: 695056 - DNA, 25 bp, Rattus norvegicus
tttgtaccaatctcgctgaagcgtc

SEQ ID NO: 695057 - DNA, 25 bp, Rattus norvegicus
tttgtaccaatgcatctgggcccaa

SEQ ID NO: 695058 - DNA, 25 bp, Rattus norvegicus
tttgtaccaatggatctgggcccaa

SEQ ID NO: 695059 - DNA, 25 bp, Rattus norvegicus
tttgtaccactgcactgttcatatc

SEQ ID NO: 695060 - DNA, 25 bp, Rattus norvegicus
tttgtaccactggactgttcatatc

SEQ ID NO: 695061 - DNA, 25 bp, Rattus norvegicus
tttgtacccaccagtaaggcctagg

SEQ ID NO: 695062 - DNA, 25 bp, Rattus norvegicus
tttgtacccacctgtaaggcctagg

SEQ ID NO: 695063 - DNA, 25 bp, Rattus norvegicus
tttgtacccctgactggcttggaac

SEQ ID NO: 695064 - DNA, 25 bp, Rattus norvegicus
tttgtacccctgtctggcttggaac

SEQ ID NO: 695065 - DNA, 25 bp, Rattus norvegicus
tttgtaccctccatttcttgccttg

SEQ ID NO: 695066 - DNA, 25 bp, Rattus norvegicus
tttgtaccctccttttcttgccttg

SEQ ID NO: 695067 - DNA, 25 bp, Rattus norvegicus
tttgtacgtatgactggtctggcac

SEQ ID NO: 695068 - DNA, 25 bp, Rattus norvegicus
tttgtacgtatgtctggtctggcac

SEQ ID NO: 695069 - DNA, 25 bp, Rattus norvegicus
tttgtacgtgataggacatttcatc

SEQ ID NO: 695070 - DNA, 25 bp, Rattus norvegicus
tttgtacgtgattggacatttcatc

SEQ ID NO: 695071 - DNA, 25 bp, Rattus norvegicus
tttgtacgttttagatccatgcagc

SEQ ID NO: 695072 - DNA, 25 bp, Rattus norvegicus
tttgtacgtttttgatccatgcagc

SEQ ID NO: 695073 - DNA, 25 bp, Rattus norvegicus
tttgtactacttcccggtgtgactc

SEQ ID NO: 695074 - DNA, 25 bp, Rattus norvegicus
tttgtactacttgccggtgtgactc

SEQ ID NO: 695075 - DNA, 25 bp, Rattus norvegicus
tttgtactatacaccgactatcgcg

SEQ ID NO: 695076 - DNA, 25 bp, Rattus norvegicus
tttgtactatactccgactatcgcg

SEQ ID NO: 695077 - DNA, 25 bp, Rattus norvegicus
tttgtactgataatgccctgaggta

SEQ ID NO: 695078 - DNA, 25 bp, Rattus norvegicus
tttgtactgatattgccctgaggta

SEQ ID NO: 695079 - DNA, 25 bp, Rattus norvegicus
tttgtactggtaatgcagattccaa

SEQ ID NO: 695080 - DNA, 25 bp, Rattus norvegicus
tttgtactggtattgcagattccaa

SEQ ID NO: 695081 - DNA, 25 bp, Rattus norvegicus
tttgtacttgataccttctccatga

SEQ ID NO: 695082 - DNA, 25 bp, Rattus norvegicus
tttgtacttgattccttctccatga

SEQ ID NO: 695083 - DNA, 25 bp, Rattus norvegicus
tttgtacttggcatacttgggttgg

SEQ ID NO: 695084 - DNA, 25 bp, Rattus norvegicus
tttgtacttggcttacttgggttgg

SEQ ID NO: 695085 - DNA, 25 bp, Rattus norvegicus
tttgtacttgtccatcctgctaaga

SEQ ID NO: 695086 - DNA, 25 bp, Rattus norvegicus
tttgtacttgtcgatcctgctaaga

SEQ ID NO: 695087 - DNA, 25 bp, Rattus norvegicus
tttgtactttatactggcctgggat

SEQ ID NO: 695088 - DNA, 25 bp, Rattus norvegicus
tttgtactttattctggcctgggat

SEQ ID NO: 695089 - DNA, 25 bp, Rattus norvegicus
tttgtagacctcatgtctctgactc

SEQ ID NO: 695090 - DNA, 25 bp, Rattus norvegicus
tttgtagacctcttgtctctgactc

SEQ ID NO: 695091 - DNA, 25 bp, Rattus norvegicus
tttgtagacgcgctcccctgaccta

SEQ ID NO: 695092 - DNA, 25 bp, Rattus norvegicus
tttgtagacgcggtcccctgaccta

SEQ ID NO: 695093 - DNA, 25 bp, Rattus norvegicus
tttgtagactcaccacccagtggat

SEQ ID NO: 695094 - DNA, 25 bp, Rattus norvegicus
tttgtagactcagcacccagtggat

SEQ ID NO: 695095 - DNA, 25 bp, Rattus norvegicus
tttgtagacttcacggctgccaaca

SEQ ID NO: 695096 - DNA, 25 bp, Rattus norvegicus
tttgtagacttctcggctgccaaca

SEQ ID NO: 695097 - DNA, 25 bp, Rattus norvegicus
tttgtagagggcaccggcagtctag

SEQ ID NO: 695098 - DNA, 25 bp, Rattus norvegicus
tttgtagagggctccggcagtctag

SEQ ID NO: 695099 - DNA, 25 bp, Rattus norvegicus
tttgtagagggtatgtctcctcctt

SEQ ID NO: 695100 - DNA, 25 bp, Rattus norvegicus
tttgtagagggtttgtctcctcctt

SEQ ID NO: 695101 - DNA, 25 bp, Rattus norvegicus
tttgtagataagaccccaggctagc

SEQ ID NO: 695102 - DNA, 25 bp, Rattus norvegicus
tttgtagataagtccccaggctagc

SEQ ID NO: 695103 - DNA, 25 bp, Rattus norvegicus
tttgtagatagtctcctttgcaccc

SEQ ID NO: 695104 - DNA, 25 bp, Rattus norvegicus
tttgtagatagtgtcctttgcaccc

SEQ ID NO: 695105 - DNA, 25 bp, Rattus norvegicus
tttgtagcagctcgcaacggttcac

SEQ ID NO: 695106 - DNA, 25 bp, Rattus norvegicus
tttgtagcagctggcaacggttcac

SEQ ID NO: 695107 - DNA, 25 bp, Rattus norvegicus
tttgtagcatccagtgctccagtca

SEQ ID NO: 695108 - DNA, 25 bp, Rattus norvegicus
tttgtagcatcctgtgctccagtca

SEQ ID NO: 695109 - DNA, 25 bp, Rattus norvegicus
tttgtagccattactaaaccctcca

SEQ ID NO: 695110 - DNA, 25 bp, Rattus norvegicus
tttgtagccatttctaaaccctcca

SEQ ID NO: 695111 - DNA, 25 bp, Rattus norvegicus
tttgtagcccagctcaactttgaat

SEQ ID NO: 695112 - DNA, 25 bp, Rattus norvegicus
tttgtagcccaggtcaactttgaat

SEQ ID NO: 695113 - DNA, 25 bp, Rattus norvegicus
tttgtagcctttatcgttgtccatc

SEQ ID NO: 695114 - DNA, 25 bp, Rattus norvegicus
tttgtagcctttttcgttgtccatc

SEQ ID NO: 695115 - DNA, 25 bp, Rattus norvegicus
tttgtagctttacgctgcttggaac

SEQ ID NO: 695116 - DNA, 25 bp, Rattus norvegicus
tttgtagctttaggctgcttggaac

SEQ ID NO: 695117 - DNA, 25 bp, Rattus norvegicus
tttgtagctttcactacacaccctg

SEQ ID NO: 695118 - DNA, 25 bp, Rattus norvegicus
tttgtagctttctctacacaccctg

SEQ ID NO: 695119 - DNA, 25 bp, Rattus norvegicus
tttgtaggacacagtggagcgtcga

SEQ ID NO: 695120 - DNA, 25 bp, Rattus norvegicus
tttgtaggacactgtggagcgtcga

SEQ ID NO: 695121 - DNA, 25 bp, Rattus norvegicus
tttgtaggacccattgcacgaactc

SEQ ID NO: 695122 - DNA, 25 bp, Rattus norvegicus
tttgtaggaccctttgcacgaactc

SEQ ID NO: 695123 - DNA, 25 bp, Rattus norvegicus
tttgtaggactgacactgcccacca

SEQ ID NO: 695124 - DNA, 25 bp, Rattus norvegicus
tttgtaggactgtcactgcccacca

SEQ ID NO: 695125 - DNA, 25 bp, Rattus norvegicus
tttgtaggagtgctacctaccacct

SEQ ID NO: 695126 - DNA, 25 bp, Rattus norvegicus
tttgtaggagtggtacctaccacct

SEQ ID NO: 695127 - DNA, 25 bp, Rattus norvegicus
tttgtaggcttcctgttctatcacg

SEQ ID NO: 695128 - DNA, 25 bp, Rattus norvegicus
tttgtaggcttcgtgttctatcacg

SEQ ID NO: 695129 - DNA, 25 bp, Rattus norvegicus
tttgtaggttcccttgtcgtgacaa

SEQ ID NO: 695130 - DNA, 25 bp, Rattus norvegicus
tttgtaggttccgttgtcgtgacaa

SEQ ID NO: 695131 - DNA, 25 bp, Rattus norvegicus
tttgtagtccaacctggcttgcagg

SEQ ID NO: 695132 - DNA, 25 bp, Rattus norvegicus
tttgtagtccaagctggcttgcagg

SEQ ID NO: 695133 - DNA, 25 bp, Rattus norvegicus
tttgtagtgctgacttgtctactgt

SEQ ID NO: 695134 - DNA, 25 bp, Rattus norvegicus
tttgtagtgctgtcttgtctactgt

SEQ ID NO: 695135 - DNA, 25 bp, Rattus norvegicus
tttgtagtttcacttttcctccagt

SEQ ID NO: 695136 - DNA, 25 bp, Rattus norvegicus
tttgtagtttcagttttcctccagt

SEQ ID NO: 695137 - DNA, 25 bp, Rattus norvegicus
tttgtatacaaaccgccctgagccc

SEQ ID NO: 695138 - DNA, 25 bp, Rattus norvegicus
tttgtatacaaagcgccctgagccc

SEQ ID NO: 695139 - DNA, 25 bp, Rattus norvegicus
tttgtataccggaaatttcctccag

SEQ ID NO: 695140 - DNA, 25 bp, Rattus norvegicus
tttgtataccggtaatttcctccag

SEQ ID NO: 695141 - DNA, 25 bp, Rattus norvegicus
tttgtatatttcatattccgcccac

SEQ ID NO: 695142 - DNA, 25 bp, Rattus norvegicus
tttgtatatttcttattccgcccac

SEQ ID NO: 695143 - DNA, 25 bp, Rattus norvegicus
tttgtatccaagctgctgaatcttg

SEQ ID NO: 695144 - DNA, 25 bp, Rattus norvegicus
tttgtatccaaggtgctgaatcttg

SEQ ID NO: 695145 - DNA, 25 bp, Rattus norvegicus
tttgtatctcatatcatgcccgtca

SEQ ID NO: 695146 - DNA, 25 bp, Rattus norvegicus
tttgtatctcatttcatgcccgtca

SEQ ID NO: 695147 - DNA, 25 bp, Rattus norvegicus
tttgtatgcaaacatggctctcccc

SEQ ID NO: 695148 - DNA, 25 bp, Rattus norvegicus
tttgtatgcaaagatggctctcccc

SEQ ID NO: 695149 - DNA, 25 bp, Rattus norvegicus
tttgtatgcactataacttccctcc

SEQ ID NO: 695150 - DNA, 25 bp, Rattus norvegicus
tttgtatgcactttaacttccctcc

SEQ ID NO: 695151 - DNA, 25 bp, Rattus norvegicus
tttgtatgtgaacttgacacaggct

SEQ ID NO: 695152 - DNA, 25 bp, Rattus norvegicus
tttgtatgtgaagttgacacaggct

SEQ ID NO: 695153 - DNA, 25 bp, Rattus norvegicus
tttgtatgtgtaacgggagcctcct

SEQ ID NO: 695154 - DNA, 25 bp, Rattus norvegicus
tttgtatgtgtatcgggagcctcct

SEQ ID NO: 695155 - DNA, 25 bp, Rattus norvegicus
tttgtatgtttgatcaccgcatccc

SEQ ID NO: 695156 - DNA, 25 bp, Rattus norvegicus
tttgtatgtttgttcaccgcatccc

SEQ ID NO: 695157 - DNA, 25 bp, Rattus norvegicus
tttgtattctttccttacaaatcac

SEQ ID NO: 695158 - DNA, 25 bp, Rattus norvegicus
tttgtattctttgcttacaaatcac

SEQ ID NO: 695159 - DNA, 25 bp, Rattus norvegicus
tttgtatttcccaccgacgataaat

SEQ ID NO: 695160 - DNA, 25 bp, Rattus norvegicus
tttgtatttccctccgacgataaat

SEQ ID NO: 695161 - DNA, 25 bp, Rattus norvegicus
tttgtatttctccatgtcatgcgct

SEQ ID NO: 695162 - DNA, 25 bp, Rattus norvegicus
tttgtatttctcgatgtcatgcgct

SEQ ID NO: 695163 - DNA, 25 bp, Rattus norvegicus
tttgtatttgatcatgctgggaagc

SEQ ID NO: 695164 - DNA, 25 bp, Rattus norvegicus
tttgtatttgatgatgctgggaagc

SEQ ID NO: 695165 - DNA, 25 bp, Rattus norvegicus
tttgtattttacacctgaacgtcag

SEQ ID NO: 695166 - DNA, 25 bp, Rattus norvegicus
tttgtattttactcctgaacgtcag

SEQ ID NO: 695167 - DNA, 25 bp, Rattus norvegicus
tttgtattttataagctcccctgta

SEQ ID NO: 695168 - DNA, 25 bp, Rattus norvegicus
tttgtattttattagctcccctgta

SEQ ID NO: 695169 - DNA, 25 bp, Rattus norvegicus
tttgtattttctagagctcaccacc

SEQ ID NO: 695170 - DNA, 25 bp, Rattus norvegicus
tttgtattttcttgagctcaccacc

SEQ ID NO: 695171 - DNA, 25 bp, Rattus norvegicus
tttgtcaaacagctgtgccgacttc

SEQ ID NO: 695172 - DNA, 25 bp, Rattus norvegicus
tttgtcaaacaggtgtgccgacttc

SEQ ID NO: 695173 - DNA, 25 bp, Rattus norvegicus
tttgtcaacgggatgcgagcagctc

SEQ ID NO: 695174 - DNA, 25 bp, Rattus norvegicus
tttgtcaacgggttgcgagcagctc

SEQ ID NO: 695175 - DNA, 25 bp, Rattus norvegicus
tttgtcaactatccaactcaggtcc

SEQ ID NO: 695176 - DNA, 25 bp, Rattus norvegicus
tttgtcaactatgcaactcaggtcc

SEQ ID NO: 695177 - DNA, 25 bp, Rattus norvegicus
tttgtcaagattagccctgtttctc

SEQ ID NO: 695178 - DNA, 25 bp, Rattus norvegicus
tttgtcaagatttgccctgtttctc

SEQ ID NO: 695179 - DNA, 25 bp, Rattus norvegicus
tttgtcaagcagaaccacccgtgta

SEQ ID NO: 695180 - DNA, 25 bp, Rattus norvegicus
tttgtcaagcagtaccacccgtgta

SEQ ID NO: 695181 - DNA, 25 bp, Rattus norvegicus
tttgtcaatgtgactggtcctggta

SEQ ID NO: 695182 - DNA, 25 bp, Rattus norvegicus
tttgtcaatgtgtctggtcctggta

SEQ ID NO: 695183 - DNA, 25 bp, Rattus norvegicus
tttgtcacagaccttctgagccaga

SEQ ID NO: 695184 - DNA, 25 bp, Rattus norvegicus
tttgtcacagacgttctgagccaga

SEQ ID NO: 695185 - DNA, 25 bp, Rattus norvegicus
tttgtcacagagattaaaccacctt

SEQ ID NO: 695186 - DNA, 25 bp, Rattus norvegicus
tttgtcacagagtttaaaccacctt

SEQ ID NO: 695187 - DNA, 25 bp, Rattus norvegicus
tttgtcacctcaacgaacacagctt

SEQ ID NO: 695188 - DNA, 25 bp, Rattus norvegicus
tttgtcacctcaccagattttctct

SEQ ID NO: 695189 - DNA, 25 bp, Rattus norvegicus
tttgtcacctcagcagattttctct

SEQ ID NO: 695190 - DNA, 25 bp, Rattus norvegicus
tttgtcacctcatcgaacacagctt

SEQ ID NO: 695191 - DNA, 25 bp, Rattus norvegicus
tttgtcacctggaggcagggcatag

SEQ ID NO: 695192 - DNA, 25 bp, Rattus norvegicus
tttgtcacctggtggcagggcatag

SEQ ID NO: 695193 - DNA, 25 bp, Rattus norvegicus
tttgtcactagaccacagcatctga

SEQ ID NO: 695194 - DNA, 25 bp, Rattus norvegicus
tttgtcactagagcacagcatctga

SEQ ID NO: 695195 - DNA, 25 bp, Rattus norvegicus
tttgtcactcaccttatacttctgg

SEQ ID NO: 695196 - DNA, 25 bp, Rattus norvegicus
tttgtcactcacgttatacttctgg

SEQ ID NO: 695197 - DNA, 25 bp, Rattus norvegicus
tttgtcactgaaccatctcaccaag

SEQ ID NO: 695198 - DNA, 25 bp, Rattus norvegicus
tttgtcactgaagcatctcaccaag

SEQ ID NO: 695199 - DNA, 25 bp, Rattus norvegicus
tttgtcagaatcaaggtggtgccat

SEQ ID NO: 695200 - DNA, 25 bp, Rattus norvegicus
tttgtcagaatctaggtggtgccat

SEQ ID NO: 695201 - DNA, 25 bp, Rattus norvegicus
tttgtcagcacccatgaatttgagt

SEQ ID NO: 695202 - DNA, 25 bp, Rattus norvegicus
tttgtcagcaccgatgaatttgagt

SEQ ID NO: 695203 - DNA, 25 bp, Rattus norvegicus
tttgtcagcagtccctcctttggag

SEQ ID NO: 695204 - DNA, 25 bp, Rattus norvegicus
tttgtcagcagtgcctcctttggag

SEQ ID NO: 695205 - DNA, 25 bp, Rattus norvegicus
tttgtcagtaacagtcacagcccgc

SEQ ID NO: 695206 - DNA, 25 bp, Rattus norvegicus
tttgtcagtaactgtcacagcccgc

SEQ ID NO: 695207 - DNA, 25 bp, Rattus norvegicus
tttgtcagtaatattttgccctttg

SEQ ID NO: 695208 - DNA, 25 bp, Rattus norvegicus
tttgtcagtaattttttgccctttg

SEQ ID NO: 695209 - DNA, 25 bp, Rattus norvegicus
tttgtcatacttagggacacctccc

SEQ ID NO: 695210 - DNA, 25 bp, Rattus norvegicus
tttgtcatactttgggacacctccc

SEQ ID NO: 695211 - DNA, 25 bp, Rattus norvegicus
tttgtcatcatgaaatgtctccagt

SEQ ID NO: 695212 - DNA, 25 bp, Rattus norvegicus
tttgtcatcatgtaatgtctccagt

SEQ ID NO: 695213 - DNA, 25 bp, Rattus norvegicus
tttgtcatccagaaactccgaggca

SEQ ID NO: 695214 - DNA, 25 bp, Rattus norvegicus
tttgtcatccagtaactccgaggca

SEQ ID NO: 695215 - DNA, 25 bp, Rattus norvegicus
tttgtcatgttcctattcgctgtca

SEQ ID NO: 695216 - DNA, 25 bp, Rattus norvegicus
tttgtcatgttcgtattcgctgtca

SEQ ID NO: 695217 - DNA, 25 bp, Rattus norvegicus
tttgtcattcaaatggcttcctatg

SEQ ID NO: 695218 - DNA, 25 bp, Rattus norvegicus
tttgtcattcaattggcttcctatg

SEQ ID NO: 695219 - DNA, 25 bp, Rattus norvegicus
tttgtccaccagctatgcacacaat

SEQ ID NO: 695220 - DNA, 25 bp, Rattus norvegicus
tttgtccaccaggtatgcacacaat

SEQ ID NO: 695221 - DNA, 25 bp, Rattus norvegicus
tttgtccacttccagacccaagagg

SEQ ID NO: 695222 - DNA, 25 bp, Rattus norvegicus
tttgtccacttcgagacccaagagg

SEQ ID NO: 695223 - DNA, 25 bp, Rattus norvegicus
tttgtccaggtccaaggcactacag

SEQ ID NO: 695224 - DNA, 25 bp, Rattus norvegicus
tttgtccaggtcgaaggcactacag

SEQ ID NO: 695225 - DNA, 25 bp, Rattus norvegicus
tttgtccagtctctatccagacttc

SEQ ID NO: 695226 - DNA, 25 bp, Rattus norvegicus
tttgtccagtctgtatccagacttc

SEQ ID NO: 695227 - DNA, 25 bp, Rattus norvegicus
tttgtccagtgtactaggctgacca

SEQ ID NO: 695228 - DNA, 25 bp, Rattus norvegicus
tttgtccagtgttctaggctgacca

SEQ ID NO: 695229 - DNA, 25 bp, Rattus norvegicus
tttgtccatctcaccttttgttttg

SEQ ID NO: 695230 - DNA, 25 bp, Rattus norvegicus
tttgtccatctctccttttgttttg

SEQ ID NO: 695231 - DNA, 25 bp, Rattus norvegicus
tttgtccatgacagttttcccacgg

SEQ ID NO: 695232 - DNA, 25 bp, Rattus norvegicus
tttgtccatgactgttttcccacgg

SEQ ID NO: 695233 - DNA, 25 bp, Rattus norvegicus
tttgtcccaagaaagcctcctggct

SEQ ID NO: 695234 - DNA, 25 bp, Rattus norvegicus
tttgtcccaagatagcctcctggct

SEQ ID NO: 695235 - DNA, 25 bp, Rattus norvegicus
tttgtcccaggcctacaatgtgcat

SEQ ID NO: 695236 - DNA, 25 bp, Rattus norvegicus
tttgtcccaggccttgggaggaact

SEQ ID NO: 695237 - DNA, 25 bp, Rattus norvegicus
tttgtcccaggcgtacaatgtgcat

SEQ ID NO: 695238 - DNA, 25 bp, Rattus norvegicus
tttgtcccaggcgttgggaggaact

SEQ ID NO: 695239 - DNA, 25 bp, Rattus norvegicus
tttgtccccaaaaggttttgctcac

SEQ ID NO: 695240 - DNA, 25 bp, Rattus norvegicus
tttgtccccaaatggttttgctcac

SEQ ID NO: 695241 - DNA, 25 bp, Rattus norvegicus
tttgtccccacacgtctaaagaagt

SEQ ID NO: 695242 - DNA, 25 bp, Rattus norvegicus
tttgtccccacactgagatgctgct

SEQ ID NO: 695243 - DNA, 25 bp, Rattus norvegicus
tttgtccccacaggtctaaagaagt

SEQ ID NO: 695244 - DNA, 25 bp, Rattus norvegicus
tttgtccccacagtgagatgctgct

SEQ ID NO: 695245 - DNA, 25 bp, Rattus norvegicus
tttgtccccgagcatcaaattcgtg

SEQ ID NO: 695246 - DNA, 25 bp, Rattus norvegicus
tttgtccccgaggatcaaattcgtg

SEQ ID NO: 695247 - DNA, 25 bp, Rattus norvegicus
tttgtccccgcgctgtgcttgggac

SEQ ID NO: 695248 - DNA, 25 bp, Rattus norvegicus
tttgtccccgcggtgtgcttgggac

SEQ ID NO: 695249 - DNA, 25 bp, Rattus norvegicus
tttgtccccgtgactcaccagtgtg

SEQ ID NO: 695250 - DNA, 25 bp, Rattus norvegicus
tttgtccccgtgtctcaccagtgtg

SEQ ID NO: 695251 - DNA, 25 bp, Rattus norvegicus
tttgtcccctgcatgggtaatggaa

SEQ ID NO: 695252 - DNA, 25 bp, Rattus norvegicus
tttgtcccctgcttgggtaatggaa

SEQ ID NO: 695253 - DNA, 25 bp, Rattus norvegicus
tttgtccccttacttcagtaattgg

SEQ ID NO: 695254 - DNA, 25 bp, Rattus norvegicus
tttgtccccttagttcagtaattgg

SEQ ID NO: 695255 - DNA, 25 bp, Rattus norvegicus
tttgtccctcgacggcaaacaaact

SEQ ID NO: 695256 - DNA, 25 bp, Rattus norvegicus
tttgtccctcgagggcaaacaaact

SEQ ID NO: 695257 - DNA, 25 bp, Rattus norvegicus
tttgtccctgtcctagaggttcagc

SEQ ID NO: 695258 - DNA, 25 bp, Rattus norvegicus
tttgtccctgtcgtagaggttcagc

SEQ ID NO: 695259 - DNA, 25 bp, Rattus norvegicus
tttgtcccttagatggctggctgtc

SEQ ID NO: 695260 - DNA, 25 bp, Rattus norvegicus
tttgtcccttagttggctggctgtc

SEQ ID NO: 695261 - DNA, 25 bp, Rattus norvegicus
tttgtccgtgccatgcaggtgctgg

SEQ ID NO: 695262 - DNA, 25 bp, Rattus norvegicus
tttgtccgtgccttgcaggtgctgg

SEQ ID NO: 695263 - DNA, 25 bp, Rattus norvegicus
tttgtcctagaacgccaggccagct

SEQ ID NO: 695264 - DNA, 25 bp, Rattus norvegicus
tttgtcctagaaggccaggccagct

SEQ ID NO: 695265 - DNA, 25 bp, Rattus norvegicus
tttgtcctcatccttgtcagtgatg

SEQ ID NO: 695266 - DNA, 25 bp, Rattus norvegicus
tttgtcctcatcgttgtcagtgatg

SEQ ID NO: 695267 - DNA, 25 bp, Rattus norvegicus
tttgtcctccttatggtcatgtact

SEQ ID NO: 695268 - DNA, 25 bp, Rattus norvegicus
tttgtcctccttttggtcatgtact

SEQ ID NO: 695269 - DNA, 25 bp, Rattus norvegicus
tttgtcctcgtgaatctattaaacc

SEQ ID NO: 695270 - DNA, 25 bp, Rattus norvegicus
tttgtcctcgtgtatctattaaacc

SEQ ID NO: 695271 - DNA, 25 bp, Rattus norvegicus
tttgtcctctatacccaatcactgc

SEQ ID NO: 695272 - DNA, 25 bp, Rattus norvegicus
tttgtcctctattcccaatcactgc

SEQ ID NO: 695273 - DNA, 25 bp, Rattus norvegicus
tttgtcctgactaattctgttcctg

SEQ ID NO: 695274 - DNA, 25 bp, Rattus norvegicus
tttgtcctgacttattctgttcctg

SEQ ID NO: 695275 - DNA, 25 bp, Rattus norvegicus
tttgtcctgccaatcactgtaaaac

SEQ ID NO: 695276 - DNA, 25 bp, Rattus norvegicus
tttgtcctgccattcactgtaaaac

SEQ ID NO: 695277 - DNA, 25 bp, Rattus norvegicus
tttgtcctgctgagcctcgggctgg

SEQ ID NO: 695278 - DNA, 25 bp, Rattus norvegicus
tttgtcctgctgtgcctcgggctgg

SEQ ID NO: 695279 - DNA, 25 bp, Rattus norvegicus
tttgtcctggagatcacctctgtgg

SEQ ID NO: 695280 - DNA, 25 bp, Rattus norvegicus
tttgtcctggagttcacctctgtgg

SEQ ID NO: 695281 - DNA, 25 bp, Rattus norvegicus
tttgtcctggatattcggcatgcaa

SEQ ID NO: 695282 - DNA, 25 bp, Rattus norvegicus
tttgtcctggattttcggcatgcaa

SEQ ID NO: 695283 - DNA, 25 bp, Rattus norvegicus
tttgtcctgtttctgtgtccatgcc

SEQ ID NO: 695284 - DNA, 25 bp, Rattus norvegicus
tttgtcctgtttgtgtgtccatgcc

SEQ ID NO: 695285 - DNA, 25 bp, Rattus norvegicus
tttgtccttgtactgtctgttcctc

SEQ ID NO: 695286 - DNA, 25 bp, Rattus norvegicus
tttgtccttgtagtgtctgttcctc

SEQ ID NO: 695287 - DNA, 25 bp, Rattus norvegicus
tttgtcctttgacttgtttctgctg

SEQ ID NO: 695288 - DNA, 25 bp, Rattus norvegicus
tttgtcctttgagttgtttctgctg

SEQ ID NO: 695289 - DNA, 25 bp, Rattus norvegicus
tttgtcgaaagtactgccagctcca

SEQ ID NO: 695290 - DNA, 25 bp, Rattus norvegicus
tttgtcgaaagttctgccagctcca

SEQ ID NO: 695291 - DNA, 25 bp, Rattus norvegicus
tttgtcgagagcaaccgtcatccat

SEQ ID NO: 695292 - DNA, 25 bp, Rattus norvegicus
tttgtcgagagctaccgtcatccat

SEQ ID NO: 695293 - DNA, 25 bp, Rattus norvegicus
tttgtcgagtgtatagaacccgtca

SEQ ID NO: 695294 - DNA, 25 bp, Rattus norvegicus
tttgtcgagtgtttagaacccgtca

SEQ ID NO: 695295 - DNA, 25 bp, Rattus norvegicus
tttgtcgcagctatgctttgtttaa

SEQ ID NO: 695296 - DNA, 25 bp, Rattus norvegicus
tttgtcgcagctttgctttgtttaa

SEQ ID NO: 695297 - DNA, 25 bp, Rattus norvegicus
tttgtcgcctacagatgactggagc

SEQ ID NO: 695298 - DNA, 25 bp, Rattus norvegicus
tttgtcgcctactgatgactggagc

SEQ ID NO: 695299 - DNA, 25 bp, Rattus norvegicus
tttgtcgctgatctccctggcagaa

SEQ ID NO: 695300 - DNA, 25 bp, Rattus norvegicus
tttgtcgctgatgtccctggcagaa

SEQ ID NO: 695301 - DNA, 25 bp, Rattus norvegicus
tttgtcggttttaaaaatctggcat

SEQ ID NO: 695302 - DNA, 25 bp, Rattus norvegicus
tttgtcggtttttaaaatctggcat

SEQ ID NO: 695303 - DNA, 25 bp, Rattus norvegicus
tttgtcgtatcaagcttctcactta

SEQ ID NO: 695304 - DNA, 25 bp, Rattus norvegicus
tttgtcgtatcatgcttctcactta

SEQ ID NO: 695305 - DNA, 25 bp, Rattus norvegicus
tttgtctacttgaacaacgcggcca

SEQ ID NO: 695306 - DNA, 25 bp, Rattus norvegicus
tttgtctacttgtacaacgcggcca

SEQ ID NO: 695307 - DNA, 25 bp, Rattus norvegicus
tttgtctagggtctcggtaactgtc

SEQ ID NO: 695308 - DNA, 25 bp, Rattus norvegicus
tttgtctagggtgtcggtaactgtc

SEQ ID NO: 695309 - DNA, 25 bp, Rattus norvegicus
tttgtctagtcacccttagcacctg

SEQ ID NO: 695310 - DNA, 25 bp, Rattus norvegicus
tttgtctagtcagccttagcacctg

SEQ ID NO: 695311 - DNA, 25 bp, Rattus norvegicus
tttgtctatgcccttatcagctaca

SEQ ID NO: 695312 - DNA, 25 bp, Rattus norvegicus
tttgtctatgccgttatcagctaca

SEQ ID NO: 695313 - DNA, 25 bp, Rattus norvegicus
tttgtctcaacactacagcaggtct

SEQ ID NO: 695314 - DNA, 25 bp, Rattus norvegicus
tttgtctcaacagtacagcaggtct

SEQ ID NO: 695315 - DNA, 25 bp, Rattus norvegicus
tttgtctcaccacagaaccagcttt

SEQ ID NO: 695316 - DNA, 25 bp, Rattus norvegicus
tttgtctcaccagagaaccagcttt

SEQ ID NO: 695317 - DNA, 25 bp, Rattus norvegicus
tttgtctcacgccagcctggccagg

SEQ ID NO: 695318 - DNA, 25 bp, Rattus norvegicus
tttgtctcacgcgagcctggccagg

SEQ ID NO: 695319 - DNA, 25 bp, Rattus norvegicus
tttgtctcactgaaagctgtctgca

SEQ ID NO: 695320 - DNA, 25 bp, Rattus norvegicus
tttgtctcactgtaagctgtctgca

SEQ ID NO: 695321 - DNA, 25 bp, Rattus norvegicus
tttgtctcagttatggtgactagat

SEQ ID NO: 695322 - DNA, 25 bp, Rattus norvegicus
tttgtctcagttttggtgactagat

SEQ ID NO: 695323 - DNA, 25 bp, Rattus norvegicus
tttgtctccccgcactatttgaaga

SEQ ID NO: 695324 - DNA, 25 bp, Rattus norvegicus
tttgtctccccggactatttgaaga

SEQ ID NO: 695325 - DNA, 25 bp, Rattus norvegicus
tttgtctccgatccattccacaaag

SEQ ID NO: 695326 - DNA, 25 bp, Rattus norvegicus
tttgtctccgatgcattccacaaag

SEQ ID NO: 695327 - DNA, 25 bp, Rattus norvegicus
tttgtctccggcaaccagtggagag

SEQ ID NO: 695328 - DNA, 25 bp, Rattus norvegicus
tttgtctccggctaccagtggagag

SEQ ID NO: 695329 - DNA, 25 bp, Rattus norvegicus
tttgtctcctgaccatgttgaccac

SEQ ID NO: 695330 - DNA, 25 bp, Rattus norvegicus
tttgtctcctgagcatgttgaccac

SEQ ID NO: 695331 - DNA, 25 bp, Rattus norvegicus
tttgtctccttacccaggcagatgg

SEQ ID NO: 695332 - DNA, 25 bp, Rattus norvegicus
tttgtctccttagccaggcagatgg

SEQ ID NO: 695333 - DNA, 25 bp, Rattus norvegicus
tttgtctctcccattcattgaggac

SEQ ID NO: 695334 - DNA, 25 bp, Rattus norvegicus
tttgtctctccctttcattgaggac

SEQ ID NO: 695335 - DNA, 25 bp, Rattus norvegicus
tttgtctctcgcatcatcagttaaa

SEQ ID NO: 695336 - DNA, 25 bp, Rattus norvegicus
tttgtctctcgcttcatcagttaaa

SEQ ID NO: 695337 - DNA, 25 bp, Rattus norvegicus
tttgtctctcttactgtattatact

SEQ ID NO: 695338 - DNA, 25 bp, Rattus norvegicus
tttgtctctctttctgtattatact

SEQ ID NO: 695339 - DNA, 25 bp, Rattus norvegicus
tttgtctctggcaacaacgtcctgg

SEQ ID NO: 695340 - DNA, 25 bp, Rattus norvegicus
tttgtctctggcctgaaagttgcat

SEQ ID NO: 695341 - DNA, 25 bp, Rattus norvegicus
tttgtctctggcgtgaaagttgcat

SEQ ID NO: 695342 - DNA, 25 bp, Rattus norvegicus
tttgtctctggctacaacgtcctgg

SEQ ID NO: 695343 - DNA, 25 bp, Rattus norvegicus
tttgtctcttgcattgttggaccca

SEQ ID NO: 695344 - DNA, 25 bp, Rattus norvegicus
tttgtctcttgctttgttggaccca

SEQ ID NO: 695345 - DNA, 25 bp, Rattus norvegicus
tttgtctgacacatacagtgccgag

SEQ ID NO: 695346 - DNA, 25 bp, Rattus norvegicus
tttgtctgacacttacagtgccgag

SEQ ID NO: 695347 - DNA, 25 bp, Rattus norvegicus
tttgtctgactaaatttgggccacc

SEQ ID NO: 695348 - DNA, 25 bp, Rattus norvegicus
tttgtctgactatatttgggccacc

SEQ ID NO: 695349 - DNA, 25 bp, Rattus norvegicus
tttgtctgagaccattaaccctgta

SEQ ID NO: 695350 - DNA, 25 bp, Rattus norvegicus
tttgtctgagacgattaaccctgta

SEQ ID NO: 695351 - DNA, 25 bp, Rattus norvegicus
tttgtctgagcgcttcacccggaag

SEQ ID NO: 695352 - DNA, 25 bp, Rattus norvegicus
tttgtctgagcggttcacccggaag

SEQ ID NO: 695353 - DNA, 25 bp, Rattus norvegicus
tttgtctgaggccaggctcgccgct

SEQ ID NO: 695354 - DNA, 25 bp, Rattus norvegicus
tttgtctgaggcgaggctcgccgct

SEQ ID NO: 695355 - DNA, 25 bp, Rattus norvegicus
tttgtctgcacaccatgatgaactt

SEQ ID NO: 695356 - DNA, 25 bp, Rattus norvegicus
tttgtctgcacagcatgatgaactt

SEQ ID NO: 695357 - DNA, 25 bp, Rattus norvegicus
tttgtctgcagcctgtcaagaccca

SEQ ID NO: 695358 - DNA, 25 bp, Rattus norvegicus
tttgtctgcagcgtgtcaagaccca

SEQ ID NO: 695359 - DNA, 25 bp, Rattus norvegicus
tttgtctgcctgattgaagtcactc

SEQ ID NO: 695360 - DNA, 25 bp, Rattus norvegicus
tttgtctgcctgctgttttagcatt

SEQ ID NO: 695361 - DNA, 25 bp, Rattus norvegicus
tttgtctgcctggtgttttagcatt

SEQ ID NO: 695362 - DNA, 25 bp, Rattus norvegicus
tttgtctgcctgtttgaagtcactc

SEQ ID NO: 695363 - DNA, 25 bp, Rattus norvegicus
tttgtctgctaaaactggccatgaa

SEQ ID NO: 695364 - DNA, 25 bp, Rattus norvegicus
tttgtctgctaatactggccatgaa

SEQ ID NO: 695365 - DNA, 25 bp, Rattus norvegicus
tttgtctgcttcataccaggtggga

SEQ ID NO: 695366 - DNA, 25 bp, Rattus norvegicus
tttgtctgcttcttaccaggtggga

SEQ ID NO: 695367 - DNA, 25 bp, Rattus norvegicus
tttgtctgtgttatatctgtgcccc

SEQ ID NO: 695368 - DNA, 25 bp, Rattus norvegicus
tttgtctgtgttttatctgtgcccc

SEQ ID NO: 695369 - DNA, 25 bp, Rattus norvegicus
tttgtctgtttgcttctttgtcttg

SEQ ID NO: 695370 - DNA, 25 bp, Rattus norvegicus
tttgtctgtttggttctttgtcttg

SEQ ID NO: 695371 - DNA, 25 bp, Rattus norvegicus
tttgtcttaatcactcaggctcaac

SEQ ID NO: 695372 - DNA, 25 bp, Rattus norvegicus
tttgtcttaatctctcaggctcaac

SEQ ID NO: 695373 - DNA, 25 bp, Rattus norvegicus
tttgtcttagcaattctctagccca

SEQ ID NO: 695374 - DNA, 25 bp, Rattus norvegicus
tttgtcttagcatttctctagccca

SEQ ID NO: 695375 - DNA, 25 bp, Rattus norvegicus
tttgtcttaggaagggctcttgttt

SEQ ID NO: 695376 - DNA, 25 bp, Rattus norvegicus
tttgtcttaggatgggctcttgttt

SEQ ID NO: 695377 - DNA, 25 bp, Rattus norvegicus
tttgtcttattaatgttgctactgt

SEQ ID NO: 695378 - DNA, 25 bp, Rattus norvegicus
tttgtcttattattgttgctactgt

SEQ ID NO: 695379 - DNA, 25 bp, Rattus norvegicus
tttgtcttcattccctactcaagaa

SEQ ID NO: 695380 - DNA, 25 bp, Rattus norvegicus
tttgtcttcattgcctactcaagaa

SEQ ID NO: 695381 - DNA, 25 bp, Rattus norvegicus
tttgtcttccatattcacccatgaa

SEQ ID NO: 695382 - DNA, 25 bp, Rattus norvegicus
tttgtcttccattttcacccatgaa

SEQ ID NO: 695383 - DNA, 25 bp, Rattus norvegicus
tttgtcttcctgacagctttgtcaa

SEQ ID NO: 695384 - DNA, 25 bp, Rattus norvegicus
tttgtcttcctgtcagctttgtcaa

SEQ ID NO: 695385 - DNA, 25 bp, Rattus norvegicus
tttgtcttccttacctagctcataa

SEQ ID NO: 695386 - DNA, 25 bp, Rattus norvegicus
tttgtcttcctttcctagctcataa

SEQ ID NO: 695387 - DNA, 25 bp, Rattus norvegicus
tttgtctttaatacttcagccctca

SEQ ID NO: 695388 - DNA, 25 bp, Rattus norvegicus
tttgtctttaattcttcagccctca

SEQ ID NO: 695389 - DNA, 25 bp, Rattus norvegicus
tttgtctttagactccagttggcct

SEQ ID NO: 695390 - DNA, 25 bp, Rattus norvegicus
tttgtctttagagtccagttggcct

SEQ ID NO: 695391 - DNA, 25 bp, Rattus norvegicus
tttgtctttctaaggatatgggcac

SEQ ID NO: 695392 - DNA, 25 bp, Rattus norvegicus
tttgtctttctatggatatgggcac

SEQ ID NO: 695393 - DNA, 25 bp, Rattus norvegicus
tttgtctttggtctgtctcctcttc

SEQ ID NO: 695394 - DNA, 25 bp, Rattus norvegicus
tttgtctttggtgtgtctcctcttc

SEQ ID NO: 695395 - DNA, 25 bp, Rattus norvegicus
tttgtgaaactcagtaccctgctac

SEQ ID NO: 695396 - DNA, 25 bp, Rattus norvegicus
tttgtgaaactctgtaccctgctac

SEQ ID NO: 695397 - DNA, 25 bp, Rattus norvegicus
tttgtgaacactcgactctgaaata

SEQ ID NO: 695398 - DNA, 25 bp, Rattus norvegicus
tttgtgaacactggactctgaaata

SEQ ID NO: 695399 - DNA, 25 bp, Rattus norvegicus
tttgtgaaccagaaatgagagcctc

SEQ ID NO: 695400 - DNA, 25 bp, Rattus norvegicus
tttgtgaaccagtaatgagagcctc

SEQ ID NO: 695401 - DNA, 25 bp, Rattus norvegicus
tttgtgaacccacccactagcaaac

SEQ ID NO: 695402 - DNA, 25 bp, Rattus norvegicus
tttgtgaacccagccactagcaaac

SEQ ID NO: 695403 - DNA, 25 bp, Rattus norvegicus
tttgtgaactgcagggacccagggc

SEQ ID NO: 695404 - DNA, 25 bp, Rattus norvegicus
tttgtgaactgctgggacccagggc

SEQ ID NO: 695405 - DNA, 25 bp, Rattus norvegicus
tttgtgaatactcacacatgtccac

SEQ ID NO: 695406 - DNA, 25 bp, Rattus norvegicus
tttgtgaatactgacacatgtccac

SEQ ID NO: 695407 - DNA, 25 bp, Rattus norvegicus
tttgtgaattccattagccctttga

SEQ ID NO: 695408 - DNA, 25 bp, Rattus norvegicus
tttgtgaattcctttagccctttga

SEQ ID NO: 695409 - DNA, 25 bp, Rattus norvegicus
tttgtgacactgaagccctgcagga

SEQ ID NO: 695410 - DNA, 25 bp, Rattus norvegicus
tttgtgacactgtagccctgcagga

SEQ ID NO: 695411 - DNA, 25 bp, Rattus norvegicus
tttgtgacagcgctttacccttcca

SEQ ID NO: 695412 - DNA, 25 bp, Rattus norvegicus
tttgtgacagcggtttacccttcca

SEQ ID NO: 695413 - DNA, 25 bp, Rattus norvegicus
tttgtgaccaccaacacataggaac

SEQ ID NO: 695414 - DNA, 25 bp, Rattus norvegicus
tttgtgaccacctacacataggaac

SEQ ID NO: 695415 - DNA, 25 bp, Rattus norvegicus
tttgtgaccctcagttttcatgcac

SEQ ID NO: 695416 - DNA, 25 bp, Rattus norvegicus
tttgtgaccctctgttttcatgcac

SEQ ID NO: 695417 - DNA, 25 bp, Rattus norvegicus
tttgtgaccggcatcgtcagctggg

SEQ ID NO: 695418 - DNA, 25 bp, Rattus norvegicus
tttgtgaccggcttcgtcagctggg

SEQ ID NO: 695419 - DNA, 25 bp, Rattus norvegicus
tttgtgactattatgtgccctgtga

SEQ ID NO: 695420 - DNA, 25 bp, Rattus norvegicus
tttgtgactattttgtgccctgtga

SEQ ID NO: 695421 - DNA, 25 bp, Rattus norvegicus
tttgtgactcacattcagactgatt

SEQ ID NO: 695422 - DNA, 25 bp, Rattus norvegicus
tttgtgactcactttcagactgatt

SEQ ID NO: 695423 - DNA, 25 bp, Rattus norvegicus
tttgtgacttggcacctcacacagc

SEQ ID NO: 695424 - DNA, 25 bp, Rattus norvegicus
tttgtgacttgggacctcacacagc

SEQ ID NO: 695425 - DNA, 25 bp, Rattus norvegicus
tttgtgactttaccctgaactctac

SEQ ID NO: 695426 - DNA, 25 bp, Rattus norvegicus
tttgtgactttagcctgaactctac

SEQ ID NO: 695427 - DNA, 25 bp, Rattus norvegicus
tttgtgactttgacagtggcagggc

SEQ ID NO: 695428 - DNA, 25 bp, Rattus norvegicus
tttgtgactttgtcagtggcagggc

SEQ ID NO: 695429 - DNA, 25 bp, Rattus norvegicus
tttgtgacttttccatttaaccctg

SEQ ID NO: 695430 - DNA, 25 bp, Rattus norvegicus
tttgtgacttttgcatttaaccctg

SEQ ID NO: 695431 - DNA, 25 bp, Rattus norvegicus
tttgtgagccggatgccctggaaac

SEQ ID NO: 695432 - DNA, 25 bp, Rattus norvegicus
tttgtgagccggttgccctggaaac

SEQ ID NO: 695433 - DNA, 25 bp, Rattus norvegicus
tttgtgagctgtagaacaccccacc

SEQ ID NO: 695434 - DNA, 25 bp, Rattus norvegicus
tttgtgagctgttgaacaccccacc

SEQ ID NO: 695435 - DNA, 25 bp, Rattus norvegicus
tttgtgagtttcattccccattgtt

SEQ ID NO: 695436 - DNA, 25 bp, Rattus norvegicus
tttgtgagtttctttccccattgtt

SEQ ID NO: 695437 - DNA, 25 bp, Rattus norvegicus
tttgtgatgcttcgaaaacccgaga

SEQ ID NO: 695438 - DNA, 25 bp, Rattus norvegicus
tttgtgatgcttggaaaacccgaga

SEQ ID NO: 695439 - DNA, 25 bp, Rattus norvegicus
tttgtgatgggcagctgtcctgctt

SEQ ID NO: 695440 - DNA, 25 bp, Rattus norvegicus
tttgtgatgggctgctgtcctgctt

SEQ ID NO: 695441 - DNA, 25 bp, Rattus norvegicus
tttgtgatttcacagggtttgggtt

SEQ ID NO: 695442 - DNA, 25 bp, Rattus norvegicus
tttgtgatttcagagggtttgggtt

SEQ ID NO: 695443 - DNA, 25 bp, Rattus norvegicus
tttgtgcaacatcactttcatttgt

SEQ ID NO: 695444 - DNA, 25 bp, Rattus norvegicus
tttgtgcaacatgactttcatttgt

SEQ ID NO: 695445 - DNA, 25 bp, Rattus norvegicus
tttgtgcacacaatccggagttggc

SEQ ID NO: 695446 - DNA, 25 bp, Rattus norvegicus
tttgtgcacacattccggagttggc

SEQ ID NO: 695447 - DNA, 25 bp, Rattus norvegicus
tttgtgcaccccaagtggaactcca

SEQ ID NO: 695448 - DNA, 25 bp, Rattus norvegicus
tttgtgcacccctagtggaactcca

SEQ ID NO: 695449 - DNA, 25 bp, Rattus norvegicus
tttgtgcactcgcacggtaccataa

SEQ ID NO: 695450 - DNA, 25 bp, Rattus norvegicus
tttgtgcactcggacggtaccataa

SEQ ID NO: 695451 - DNA, 25 bp, Rattus norvegicus
tttgtgcactctctgagcatgctta

SEQ ID NO: 695452 - DNA, 25 bp, Rattus norvegicus
tttgtgcactctgtgagcatgctta

SEQ ID NO: 695453 - DNA, 25 bp, Rattus norvegicus
tttgtgcagcttctatctctccttg

SEQ ID NO: 695454 - DNA, 25 bp, Rattus norvegicus
tttgtgcagcttctgataccttgga

SEQ ID NO: 695455 - DNA, 25 bp, Rattus norvegicus
tttgtgcagcttgtatctctccttg

SEQ ID NO: 695456 - DNA, 25 bp, Rattus norvegicus
tttgtgcagcttgtgataccttgga

SEQ ID NO: 695457 - DNA, 25 bp, Rattus norvegicus
tttgtgcagtggcacgagctactct

SEQ ID NO: 695458 - DNA, 25 bp, Rattus norvegicus
tttgtgcagtgggacgagctactct

SEQ ID NO: 695459 - DNA, 25 bp, Rattus norvegicus
tttgtgccacagacgtttccagaag

SEQ ID NO: 695460 - DNA, 25 bp, Rattus norvegicus
tttgtgccacagtcgtttccagaag

SEQ ID NO: 695461 - DNA, 25 bp, Rattus norvegicus
tttgtgccatcaactgggccttcgg

SEQ ID NO: 695462 - DNA, 25 bp, Rattus norvegicus
tttgtgccatcatctgggccttcgg

SEQ ID NO: 695463 - DNA, 25 bp, Rattus norvegicus
tttgtgccattgatcgaaaacgttc

SEQ ID NO: 695464 - DNA, 25 bp, Rattus norvegicus
tttgtgccattgttcgaaaacgttc

SEQ ID NO: 695465 - DNA, 25 bp, Rattus norvegicus
tttgtgcccggcaaaggagttcacc

SEQ ID NO: 695466 - DNA, 25 bp, Rattus norvegicus
tttgtgcccggctaaggagttcacc

SEQ ID NO: 695467 - DNA, 25 bp, Rattus norvegicus
tttgtgcccttccagtgctgcagtt

SEQ ID NO: 695468 - DNA, 25 bp, Rattus norvegicus
tttgtgcccttcgagtgctgcagtt

SEQ ID NO: 695469 - DNA, 25 bp, Rattus norvegicus
tttgtgccgagtacagagatagagt

SEQ ID NO: 695470 - DNA, 25 bp, Rattus norvegicus
tttgtgccgagttcagagatagagt

SEQ ID NO: 695471 - DNA, 25 bp, Rattus norvegicus
tttgtgcctactatgctcattacca

SEQ ID NO: 695472 - DNA, 25 bp, Rattus norvegicus
tttgtgcctactttgctcattacca

SEQ ID NO: 695473 - DNA, 25 bp, Rattus norvegicus
tttgtgcctatgaccacaagctgga

SEQ ID NO: 695474 - DNA, 25 bp, Rattus norvegicus
tttgtgcctatgtccacaagctgga

SEQ ID NO: 695475 - DNA, 25 bp, Rattus norvegicus
tttgtgcgcgctactaagttacctt

SEQ ID NO: 695476 - DNA, 25 bp, Rattus norvegicus
tttgtgcgcgcttctaagttacctt

SEQ ID NO: 695477 - DNA, 25 bp, Rattus norvegicus
tttgtgctaaccaatcagatctctg

SEQ ID NO: 695478 - DNA, 25 bp, Rattus norvegicus
tttgtgctaacctatcagatctctg

SEQ ID NO: 695479 - DNA, 25 bp, Rattus norvegicus
tttgtgctaggcaccagagctgcca

SEQ ID NO: 695480 - DNA, 25 bp, Rattus norvegicus
tttgtgctaggctccagagctgcca

SEQ ID NO: 695481 - DNA, 25 bp, Rattus norvegicus
tttgtgctatcaccccatatctaag

SEQ ID NO: 695482 - DNA, 25 bp, Rattus norvegicus
tttgtgctatcagcccatatctaag

SEQ ID NO: 695483 - DNA, 25 bp, Rattus norvegicus
tttgtgctcaaaactgtgtaactgt

SEQ ID NO: 695484 - DNA, 25 bp, Rattus norvegicus
tttgtgctcaaatctgtgtaactgt

SEQ ID NO: 695485 - DNA, 25 bp, Rattus norvegicus
tttgtgctccttagattcatctgcc

SEQ ID NO: 695486 - DNA, 25 bp, Rattus norvegicus
tttgtgctcctttgattcatctgcc

SEQ ID NO: 695487 - DNA, 25 bp, Rattus norvegicus
tttgtgctcggcagcaggccagctg

SEQ ID NO: 695488 - DNA, 25 bp, Rattus norvegicus
tttgtgctcggctgcaggccagctg

SEQ ID NO: 695489 - DNA, 25 bp, Rattus norvegicus
tttgtgctcgtaactgatcaggcta

SEQ ID NO: 695490 - DNA, 25 bp, Rattus norvegicus
tttgtgctcgtatctgatcaggcta

SEQ ID NO: 695491 - DNA, 25 bp, Rattus norvegicus
tttgtgctgctgcttgtgcacgata

SEQ ID NO: 695492 - DNA, 25 bp, Rattus norvegicus
tttgtgctgctggttgtgcacgata

SEQ ID NO: 695493 - DNA, 25 bp, Rattus norvegicus
tttgtgctggaaattgaacccggat

SEQ ID NO: 695494 - DNA, 25 bp, Rattus norvegicus
tttgtgctggaatttgaacccggat

SEQ ID NO: 695495 - DNA, 25 bp, Rattus norvegicus
tttgtgcttcagaaatcccagccga

SEQ ID NO: 695496 - DNA, 25 bp, Rattus norvegicus
tttgtgcttcagtaatcccagccga

SEQ ID NO: 695497 - DNA, 25 bp, Rattus norvegicus
tttgtgcttgtaccagagcctgcag

SEQ ID NO: 695498 - DNA, 25 bp, Rattus norvegicus
tttgtgcttgtagcagagcctgcag

SEQ ID NO: 695499 - DNA, 25 bp, Rattus norvegicus
tttgtgctttacactctgtgtgatg

SEQ ID NO: 695500 - DNA, 25 bp, Rattus norvegicus
tttgtgctttactctctgtgtgatg

SEQ ID NO: 695501 - DNA, 25 bp, Rattus norvegicus
tttgtggaatccaatgtctgtagat

SEQ ID NO: 695502 - DNA, 25 bp, Rattus norvegicus
tttgtggaatcctatgtctgtagat

SEQ ID NO: 695503 - DNA, 25 bp, Rattus norvegicus
tttgtggacactaagcagcatggct

SEQ ID NO: 695504 - DNA, 25 bp, Rattus norvegicus
tttgtggacacttagcagcatggct

SEQ ID NO: 695505 - DNA, 25 bp, Rattus norvegicus
tttgtggacctcatagcctgaacac

SEQ ID NO: 695506 - DNA, 25 bp, Rattus norvegicus
tttgtggacctcttagcctgaacac

SEQ ID NO: 695507 - DNA, 25 bp, Rattus norvegicus
tttgtggacggaatcggaacacgct

SEQ ID NO: 695508 - DNA, 25 bp, Rattus norvegicus
tttgtggacggattcggaacacgct

SEQ ID NO: 695509 - DNA, 25 bp, Rattus norvegicus
tttgtggagactaccttacccagga

SEQ ID NO: 695510 - DNA, 25 bp, Rattus norvegicus
tttgtggagacttccttacccagga

SEQ ID NO: 695511 - DNA, 25 bp, Rattus norvegicus
tttgtggagcacacccctgtatgta

SEQ ID NO: 695512 - DNA, 25 bp, Rattus norvegicus
tttgtggagcactcccctgtatgta

SEQ ID NO: 695513 - DNA, 25 bp, Rattus norvegicus
tttgtggagcccaacaagcctggag

SEQ ID NO: 695514 - DNA, 25 bp, Rattus norvegicus
tttgtggagccctacaagcctggag

SEQ ID NO: 695515 - DNA, 25 bp, Rattus norvegicus
tttgtggatttcaagatctctgaga

SEQ ID NO: 695516 - DNA, 25 bp, Rattus norvegicus
tttgtggatttctagatctctgaga

SEQ ID NO: 695517 - DNA, 25 bp, Rattus norvegicus
tttgtggcaacgactctcctagctg

SEQ ID NO: 695518 - DNA, 25 bp, Rattus norvegicus
tttgtggcaacgtctctcctagctg

SEQ ID NO: 695519 - DNA, 25 bp, Rattus norvegicus
tttgtggcaactaaacgcggcatcc

SEQ ID NO: 695520 - DNA, 25 bp, Rattus norvegicus
tttgtggcaacttaacgcggcatcc

SEQ ID NO: 695521 - DNA, 25 bp, Rattus norvegicus
tttgtggcagatcttcagcttggtc

SEQ ID NO: 695522 - DNA, 25 bp, Rattus norvegicus
tttgtggcagatgttcagcttggtc

SEQ ID NO: 695523 - DNA, 25 bp, Rattus norvegicus
tttgtggccaacagagactaaccaa

SEQ ID NO: 695524 - DNA, 25 bp, Rattus norvegicus
tttgtggccaactgagactaaccaa

SEQ ID NO: 695525 - DNA, 25 bp, Rattus norvegicus
tttgtggccatcaaaacagcccagg

SEQ ID NO: 695526 - DNA, 25 bp, Rattus norvegicus
tttgtggccatcaggaacctgctta

SEQ ID NO: 695527 - DNA, 25 bp, Rattus norvegicus
tttgtggccatctaaacagcccagg

SEQ ID NO: 695528 - DNA, 25 bp, Rattus norvegicus
tttgtggccatctggaacctgctta

SEQ ID NO: 695529 - DNA, 25 bp, Rattus norvegicus
tttgtggccctcatcagcaatctgt

SEQ ID NO: 695530 - DNA, 25 bp, Rattus norvegicus
tttgtggccctcttcagcaatctgt

SEQ ID NO: 695531 - DNA, 25 bp, Rattus norvegicus
tttgtggcctaaaaagctctgctta

SEQ ID NO: 695532 - DNA, 25 bp, Rattus norvegicus
tttgtggcctaataagctctgctta

SEQ ID NO: 695533 - DNA, 25 bp, Rattus norvegicus
tttgtggctacaaatatctgagctt

SEQ ID NO: 695534 - DNA, 25 bp, Rattus norvegicus
tttgtggctacatatatctgagctt

SEQ ID NO: 695535 - DNA, 25 bp, Rattus norvegicus
tttgtggctggacgtttagtccccg

SEQ ID NO: 695536 - DNA, 25 bp, Rattus norvegicus
tttgtggctggaggtttagtccccg

SEQ ID NO: 695537 - DNA, 25 bp, Rattus norvegicus
tttgtggcttccaagggatttcctt

SEQ ID NO: 695538 - DNA, 25 bp, Rattus norvegicus
tttgtggcttcctagggatttcctt

SEQ ID NO: 695539 - DNA, 25 bp, Rattus norvegicus
tttgtggctttcctattgtcactgt

SEQ ID NO: 695540 - DNA, 25 bp, Rattus norvegicus
tttgtggctttcgtattgtcactgt

SEQ ID NO: 695541 - DNA, 25 bp, Rattus norvegicus
tttgtgggacaactgtggcacctgc

SEQ ID NO: 695542 - DNA, 25 bp, Rattus norvegicus
tttgtgggacaagtgtggcacctgc

SEQ ID NO: 695543 - DNA, 25 bp, Rattus norvegicus
tttgtgggccaacaatactctctct

SEQ ID NO: 695544 - DNA, 25 bp, Rattus norvegicus
tttgtgggccaagaatactctctct

SEQ ID NO: 695545 - DNA, 25 bp, Rattus norvegicus
tttgtgggcctgatacattcctcac

SEQ ID NO: 695546 - DNA, 25 bp, Rattus norvegicus
tttgtgggcctgttacattcctcac

SEQ ID NO: 695547 - DNA, 25 bp, Rattus norvegicus
tttgtgggcttcatctctttagaga

SEQ ID NO: 695548 - DNA, 25 bp, Rattus norvegicus
tttgtgggcttcttctctttagaga

SEQ ID NO: 695549 - DNA, 25 bp, Rattus norvegicus
tttgtgggttccagacttgtagtta

SEQ ID NO: 695550 - DNA, 25 bp, Rattus norvegicus
tttgtgggttcctgacttgtagtta

SEQ ID NO: 695551 - DNA, 25 bp, Rattus norvegicus
tttgtggtaactctgctaaaaatag

SEQ ID NO: 695552 - DNA, 25 bp, Rattus norvegicus
tttgtggtaactgtgctaaaaatag

SEQ ID NO: 695553 - DNA, 25 bp, Rattus norvegicus
tttgtggtaggccatatccctttcc

SEQ ID NO: 695554 - DNA, 25 bp, Rattus norvegicus
tttgtggtaggcgatatccctttcc

SEQ ID NO: 695555 - DNA, 25 bp, Rattus norvegicus
tttgtggtctgactgtctctctgaa

SEQ ID NO: 695556 - DNA, 25 bp, Rattus norvegicus
tttgtggtctgagtgtctctctgaa

SEQ ID NO: 695557 - DNA, 25 bp, Rattus norvegicus
tttgtggtgacccttgtgttatttc

SEQ ID NO: 695558 - DNA, 25 bp, Rattus norvegicus
tttgtggtgaccgttgtgttatttc

SEQ ID NO: 695559 - DNA, 25 bp, Rattus norvegicus
tttgtgtaagacagtctaatttgaa

SEQ ID NO: 695560 - DNA, 25 bp, Rattus norvegicus
tttgtgtaagactgtctaatttgaa

SEQ ID NO: 695561 - DNA, 25 bp, Rattus norvegicus
tttgtgtaaggtcgcctcagcggtc

SEQ ID NO: 695562 - DNA, 25 bp, Rattus norvegicus
tttgtgtaaggtggcctcagcggtc

SEQ ID NO: 695563 - DNA, 25 bp, Rattus norvegicus
tttgtgtactgtctgagtcactatc

SEQ ID NO: 695564 - DNA, 25 bp, Rattus norvegicus
tttgtgtactgtgtgagtcactatc

SEQ ID NO: 695565 - DNA, 25 bp, Rattus norvegicus
tttgtgtactttatgtgggtcgcaa

SEQ ID NO: 695566 - DNA, 25 bp, Rattus norvegicus
tttgtgtactttttgtgggtcgcaa

SEQ ID NO: 695567 - DNA, 25 bp, Rattus norvegicus
tttgtgtatcaactgctgcacacgt

SEQ ID NO: 695568 - DNA, 25 bp, Rattus norvegicus
tttgtgtatcaagtgctgcacacgt

SEQ ID NO: 695569 - DNA, 25 bp, Rattus norvegicus
tttgtgtcccagatgtgactctcac

SEQ ID NO: 695570 - DNA, 25 bp, Rattus norvegicus
tttgtgtcccagttgtgactctcac

SEQ ID NO: 695571 - DNA, 25 bp, Rattus norvegicus
tttgtgtctactctttatttattgt

SEQ ID NO: 695572 - DNA, 25 bp, Rattus norvegicus
tttgtgtctactgtttatttattgt

SEQ ID NO: 695573 - DNA, 25 bp, Rattus norvegicus
tttgtgtctcttactgctgttacca

SEQ ID NO: 695574 - DNA, 25 bp, Rattus norvegicus
tttgtgtctctttctgctgttacca

SEQ ID NO: 695575 - DNA, 25 bp, Rattus norvegicus
tttgtgtctggtctcttgtaatgaa

SEQ ID NO: 695576 - DNA, 25 bp, Rattus norvegicus
tttgtgtctggtgtcttgtaatgaa

SEQ ID NO: 695577 - DNA, 25 bp, Rattus norvegicus
tttgtgtctgtcataattccctttg

SEQ ID NO: 695578 - DNA, 25 bp, Rattus norvegicus
tttgtgtctgtcttaattccctttg

SEQ ID NO: 695579 - DNA, 25 bp, Rattus norvegicus
tttgtgtcttccactgacttcagta

SEQ ID NO: 695580 - DNA, 25 bp, Rattus norvegicus
tttgtgtcttcctctgacttcagta

SEQ ID NO: 695581 - DNA, 25 bp, Rattus norvegicus
tttgtgtgacccacttgaatgatca

SEQ ID NO: 695582 - DNA, 25 bp, Rattus norvegicus
tttgtgtgaccctcttgaatgatca

SEQ ID NO: 695583 - DNA, 25 bp, Rattus norvegicus
tttgtgtgagagcacctccatgccc

SEQ ID NO: 695584 - DNA, 25 bp, Rattus norvegicus
tttgtgtgagaggacctccatgccc

SEQ ID NO: 695585 - DNA, 25 bp, Rattus norvegicus
tttgtgtgagccaggaccccaaaac

SEQ ID NO: 695586 - DNA, 25 bp, Rattus norvegicus
tttgtgtgagcctggaccccaaaac

SEQ ID NO: 695587 - DNA, 25 bp, Rattus norvegicus
tttgtgtgcaaacgcccgaggcaga

SEQ ID NO: 695588 - DNA, 25 bp, Rattus norvegicus
tttgtgtgcaaaggcccgaggcaga

SEQ ID NO: 695589 - DNA, 25 bp, Rattus norvegicus
tttgtgtgcaggcttcttaagaagg

SEQ ID NO: 695590 - DNA, 25 bp, Rattus norvegicus
tttgtgtgcagggttcttaagaagg

SEQ ID NO: 695591 - DNA, 25 bp, Rattus norvegicus
tttgtgtgcctgcaatgcccctgga

SEQ ID NO: 695592 - DNA, 25 bp, Rattus norvegicus
tttgtgtgcctggaatgcccctgga

SEQ ID NO: 695593 - DNA, 25 bp, Rattus norvegicus
tttgtgtgcggcagtgtcaaccact

SEQ ID NO: 695594 - DNA, 25 bp, Rattus norvegicus
tttgtgtgcggctgtgtcaaccact

SEQ ID NO: 695595 - DNA, 25 bp, Rattus norvegicus
tttgtgtggcctccttaaactagct

SEQ ID NO: 695596 - DNA, 25 bp, Rattus norvegicus
tttgtgtggcctgcttaaactagct

SEQ ID NO: 695597 - DNA, 25 bp, Rattus norvegicus
tttgtgtggctacaacatcgcctct

SEQ ID NO: 695598 - DNA, 25 bp, Rattus norvegicus
tttgtgtggctagaacatcgcctct

SEQ ID NO: 695599 - DNA, 25 bp, Rattus norvegicus
tttgtgtggcttcctatttagtacc

SEQ ID NO: 695600 - DNA, 25 bp, Rattus norvegicus
tttgtgtggcttgctatttagtacc

SEQ ID NO: 695601 - DNA, 25 bp, Rattus norvegicus
tttgtgtggtctactccccgtcttc

SEQ ID NO: 695602 - DNA, 25 bp, Rattus norvegicus
tttgtgtggtcttctccccgtcttc

SEQ ID NO: 695603 - DNA, 25 bp, Rattus norvegicus
tttgtgtgtattctgcacggcttta

SEQ ID NO: 695604 - DNA, 25 bp, Rattus norvegicus
tttgtgtgtattgtgcacggcttta

SEQ ID NO: 695605 - DNA, 25 bp, Rattus norvegicus
tttgtgtgtgttaagaggtgttcta

SEQ ID NO: 695606 - DNA, 25 bp, Rattus norvegicus
tttgtgtgtgtttagaggtgttcta

SEQ ID NO: 695607 - DNA, 25 bp, Rattus norvegicus
tttgtgttacaaagggccagatgac

SEQ ID NO: 695608 - DNA, 25 bp, Rattus norvegicus
tttgtgttacaatgggccagatgac

SEQ ID NO: 695609 - DNA, 25 bp, Rattus norvegicus
tttgtgttatgtactgtctgttaga

SEQ ID NO: 695610 - DNA, 25 bp, Rattus norvegicus
tttgtgttatgttctgtctgttaga

SEQ ID NO: 695611 - DNA, 25 bp, Rattus norvegicus
tttgtgttattcatccaagtcttga

SEQ ID NO: 695612 - DNA, 25 bp, Rattus norvegicus
tttgtgttattcttccaagtcttga

SEQ ID NO: 695613 - DNA, 25 bp, Rattus norvegicus
tttgtgttccctactctgactgtcc

SEQ ID NO: 695614 - DNA, 25 bp, Rattus norvegicus
tttgtgttcccttctctgactgtcc

SEQ ID NO: 695615 - DNA, 25 bp, Rattus norvegicus
tttgtgttcgtactttcttgtgtcc

SEQ ID NO: 695616 - DNA, 25 bp, Rattus norvegicus
tttgtgttcgtagtttcttgtgtcc

SEQ ID NO: 695617 - DNA, 25 bp, Rattus norvegicus
tttgtgttctcaccctgttataaca

SEQ ID NO: 695618 - DNA, 25 bp, Rattus norvegicus
tttgtgttctcagcctgttataaca

SEQ ID NO: 695619 - DNA, 25 bp, Rattus norvegicus
tttgtgttgttactgctgctctgtg

SEQ ID NO: 695620 - DNA, 25 bp, Rattus norvegicus
tttgtgttgttagtgctgctctgtg

SEQ ID NO: 695621 - DNA, 25 bp, Rattus norvegicus
tttgtgtttatgactattccttgag

SEQ ID NO: 695622 - DNA, 25 bp, Rattus norvegicus
tttgtgtttatgtctattccttgag

SEQ ID NO: 695623 - DNA, 25 bp, Rattus norvegicus
tttgtgtttccccactgttccataa

SEQ ID NO: 695624 - DNA, 25 bp, Rattus norvegicus
tttgtgtttcccgactgttccataa

SEQ ID NO: 695625 - DNA, 25 bp, Rattus norvegicus
tttgtgtttgctcccttactggaat

SEQ ID NO: 695626 - DNA, 25 bp, Rattus norvegicus
tttgtgtttgctgccttactggaat

SEQ ID NO: 695627 - DNA, 25 bp, Rattus norvegicus
tttgtgtttgggatacctcacggag

SEQ ID NO: 695628 - DNA, 25 bp, Rattus norvegicus
tttgtgtttgggttacctcacggag

SEQ ID NO: 695629 - DNA, 25 bp, Rattus norvegicus
tttgtgttttctcgtgaccccaatg

SEQ ID NO: 695630 - DNA, 25 bp, Rattus norvegicus
tttgtgttttctggtgaccccaatg

SEQ ID NO: 695631 - DNA, 25 bp, Rattus norvegicus
tttgtgttttgccaagcttgtccct

SEQ ID NO: 695632 - DNA, 25 bp, Rattus norvegicus
tttgtgttttgcgaagcttgtccct

SEQ ID NO: 695633 - DNA, 25 bp, Rattus norvegicus
tttgtgtttttactcctctcaggac

SEQ ID NO: 695634 - DNA, 25 bp, Rattus norvegicus
tttgtgtttttagtcctctcaggac

SEQ ID NO: 695635 - DNA, 25 bp, Rattus norvegicus
tttgttaaagcacccactggtcctc

SEQ ID NO: 695636 - DNA, 25 bp, Rattus norvegicus
tttgttaaagcagccactggtcctc

SEQ ID NO: 695637 - DNA, 25 bp, Rattus norvegicus
tttgttaatctgacctttgttcctt

SEQ ID NO: 695638 - DNA, 25 bp, Rattus norvegicus
tttgttaatctgtcctttgttcctt

SEQ ID NO: 695639 - DNA, 25 bp, Rattus norvegicus
tttgttaatgttatccccgatgact

SEQ ID NO: 695640 - DNA, 25 bp, Rattus norvegicus
tttgttaatgttttccccgatgact

SEQ ID NO: 695641 - DNA, 25 bp, Rattus norvegicus
tttgttacactcctttcccaagaat

SEQ ID NO: 695642 - DNA, 25 bp, Rattus norvegicus
tttgttacactcgtttcccaagaat

SEQ ID NO: 695643 - DNA, 25 bp, Rattus norvegicus
tttgttacatcactctctgctctag

SEQ ID NO: 695644 - DNA, 25 bp, Rattus norvegicus
tttgttacatcagtctctgctctag

SEQ ID NO: 695645 - DNA, 25 bp, Rattus norvegicus
tttgttaccaacattatcacgagag

SEQ ID NO: 695646 - DNA, 25 bp, Rattus norvegicus
tttgttaccaactttatcacgagag

SEQ ID NO: 695647 - DNA, 25 bp, Rattus norvegicus
tttgttacctagcaacccactgtgc

SEQ ID NO: 695648 - DNA, 25 bp, Rattus norvegicus
tttgttacctaggaacccactgtgc

SEQ ID NO: 695649 - DNA, 25 bp, Rattus norvegicus
tttgttacggcaaccacgagccaaa

SEQ ID NO: 695650 - DNA, 25 bp, Rattus norvegicus
tttgttacggcatccacgagccaaa

SEQ ID NO: 695651 - DNA, 25 bp, Rattus norvegicus
tttgttactagtacacagggtcatg

SEQ ID NO: 695652 - DNA, 25 bp, Rattus norvegicus
tttgttactagttcacagggtcatg

SEQ ID NO: 695653 - DNA, 25 bp, Rattus norvegicus
tttgttactcttacagtaccatccc

SEQ ID NO: 695654 - DNA, 25 bp, Rattus norvegicus
tttgttactctttcagtaccatccc

SEQ ID NO: 695655 - DNA, 25 bp, Rattus norvegicus
tttgttactgggactcttactcttc

SEQ ID NO: 695656 - DNA, 25 bp, Rattus norvegicus
tttgttactgggtctcttactcttc

SEQ ID NO: 695657 - DNA, 25 bp, Rattus norvegicus
tttgttagccaacactgagtttcct

SEQ ID NO: 695658 - DNA, 25 bp, Rattus norvegicus
tttgttagccaagactgagtttcct

SEQ ID NO: 695659 - DNA, 25 bp, Rattus norvegicus
tttgttatatcccagtccccaagtt

SEQ ID NO: 695660 - DNA, 25 bp, Rattus norvegicus
tttgttatatccgagtccccaagtt

SEQ ID NO: 695661 - DNA, 25 bp, Rattus norvegicus
tttgttatccatatccatcccagaa

SEQ ID NO: 695662 - DNA, 25 bp, Rattus norvegicus
tttgttatccatttccatcccagaa

SEQ ID NO: 695663 - DNA, 25 bp, Rattus norvegicus
tttgttatctacactgaccaggctg

SEQ ID NO: 695664 - DNA, 25 bp, Rattus norvegicus
tttgttatctactctgaccaggctg

SEQ ID NO: 695665 - DNA, 25 bp, Rattus norvegicus
tttgttatctttcacgacacccaag

SEQ ID NO: 695666 - DNA, 25 bp, Rattus norvegicus
tttgttatctttgacgacacccaag

SEQ ID NO: 695667 - DNA, 25 bp, Rattus norvegicus
tttgttatgttgcacctggagagct

SEQ ID NO: 695668 - DNA, 25 bp, Rattus norvegicus
tttgttatgttggacctggagagct

SEQ ID NO: 695669 - DNA, 25 bp, Rattus norvegicus
tttgttattcctcgcagtgcgctcc

SEQ ID NO: 695670 - DNA, 25 bp, Rattus norvegicus
tttgttattcctggcagtgcgctcc

SEQ ID NO: 695671 - DNA, 25 bp, Rattus norvegicus
tttgttattggcatgcatgtctatc

SEQ ID NO: 695672 - DNA, 25 bp, Rattus norvegicus
tttgttattggcttgcatgtctatc

SEQ ID NO: 695673 - DNA, 25 bp, Rattus norvegicus
tttgttatttatacccccagctatc

SEQ ID NO: 695674 - DNA, 25 bp, Rattus norvegicus
tttgttatttattcccccagctatc

SEQ ID NO: 695675 - DNA, 25 bp, Rattus norvegicus
tttgttcaacacagtagcccctgga

SEQ ID NO: 695676 - DNA, 25 bp, Rattus norvegicus
tttgttcaacactgtagcccctgga

SEQ ID NO: 695677 - DNA, 25 bp, Rattus norvegicus
tttgttcaagaactttccctcctca

SEQ ID NO: 695678 - DNA, 25 bp, Rattus norvegicus
tttgttcaagaagtttccctcctca

SEQ ID NO: 695679 - DNA, 25 bp, Rattus norvegicus
tttgttcacagcatcatatattctt

SEQ ID NO: 695680 - DNA, 25 bp, Rattus norvegicus
tttgttcacagcttcatatattctt

SEQ ID NO: 695681 - DNA, 25 bp, Rattus norvegicus
tttgttcaccagatcattgaatctt

SEQ ID NO: 695682 - DNA, 25 bp, Rattus norvegicus
tttgttcaccagttcattgaatctt

SEQ ID NO: 695683 - DNA, 25 bp, Rattus norvegicus
tttgttcacttgatcctgtctttat

SEQ ID NO: 695684 - DNA, 25 bp, Rattus norvegicus
tttgttcacttgttcctgtctttat

SEQ ID NO: 695685 - DNA, 25 bp, Rattus norvegicus
tttgttcagtcgactgctcacctag

SEQ ID NO: 695686 - DNA, 25 bp, Rattus norvegicus
tttgttcagtcgtctgctcacctag

SEQ ID NO: 695687 - DNA, 25 bp, Rattus norvegicus
tttgttccaccaccctacatgtgta

SEQ ID NO: 695688 - DNA, 25 bp, Rattus norvegicus
tttgttccaccagcctacatgtgta

SEQ ID NO: 695689 - DNA, 25 bp, Rattus norvegicus
tttgttccacggaattgcaacccgg

SEQ ID NO: 695690 - DNA, 25 bp, Rattus norvegicus
tttgttccacggtattgcaacccgg

SEQ ID NO: 695691 - DNA, 25 bp, Rattus norvegicus
tttgttccagttctgatcattgtga

SEQ ID NO: 695692 - DNA, 25 bp, Rattus norvegicus
tttgttccagttgtgatcattgtga

SEQ ID NO: 695693 - DNA, 25 bp, Rattus norvegicus
tttgttccatttcccttataacctg

SEQ ID NO: 695694 - DNA, 25 bp, Rattus norvegicus
tttgttccatttgccttataacctg

SEQ ID NO: 695695 - DNA, 25 bp, Rattus norvegicus
tttgttcccataagctatacctttg

SEQ ID NO: 695696 - DNA, 25 bp, Rattus norvegicus
tttgttcccatatgctatacctttg

SEQ ID NO: 695697 - DNA, 25 bp, Rattus norvegicus
tttgttccccacaactgggcagagg

SEQ ID NO: 695698 - DNA, 25 bp, Rattus norvegicus
tttgttccccacagctcttaaatgt

SEQ ID NO: 695699 - DNA, 25 bp, Rattus norvegicus
tttgttccccactactgggcagagg

SEQ ID NO: 695700 - DNA, 25 bp, Rattus norvegicus
tttgttccccactgctcttaaatgt

SEQ ID NO: 695701 - DNA, 25 bp, Rattus norvegicus
tttgttcccctaataaagtcctgca

SEQ ID NO: 695702 - DNA, 25 bp, Rattus norvegicus
tttgttcccctattaaagtcctgca

SEQ ID NO: 695703 - DNA, 25 bp, Rattus norvegicus
tttgttccctctcctcatagaagaa

SEQ ID NO: 695704 - DNA, 25 bp, Rattus norvegicus
tttgttccctctgctcatagaagaa

SEQ ID NO: 695705 - DNA, 25 bp, Rattus norvegicus
tttgttccggagatattaaacacat

SEQ ID NO: 695706 - DNA, 25 bp, Rattus norvegicus
tttgttccggagttattaaacacat

SEQ ID NO: 695707 - DNA, 25 bp, Rattus norvegicus
tttgttcctgaaattgtactgtgag

SEQ ID NO: 695708 - DNA, 25 bp, Rattus norvegicus
tttgttcctgaatttgtactgtgag

SEQ ID NO: 695709 - DNA, 25 bp, Rattus norvegicus
tttgttcctgctcgttctgaaccca

SEQ ID NO: 695710 - DNA, 25 bp, Rattus norvegicus
tttgttcctgctggttctgaaccca

SEQ ID NO: 695711 - DNA, 25 bp, Rattus norvegicus
tttgttcctggcattcagaagacca

SEQ ID NO: 695712 - DNA, 25 bp, Rattus norvegicus
tttgttcctggctttcagaagacca

SEQ ID NO: 695713 - DNA, 25 bp, Rattus norvegicus
tttgttcctgtcagtggaccagcat

SEQ ID NO: 695714 - DNA, 25 bp, Rattus norvegicus
tttgttcctgtctgtggaccagcat

SEQ ID NO: 695715 - DNA, 25 bp, Rattus norvegicus
tttgttcctgttatattggctttat

SEQ ID NO: 695716 - DNA, 25 bp, Rattus norvegicus
tttgttcctgttttattggctttat

SEQ ID NO: 695717 - DNA, 25 bp, Rattus norvegicus
tttgttccttaaatggaagcctatc

SEQ ID NO: 695718 - DNA, 25 bp, Rattus norvegicus
tttgttccttaattggaagcctatc

SEQ ID NO: 695719 - DNA, 25 bp, Rattus norvegicus
tttgttccttatatccttcaccacg

SEQ ID NO: 695720 - DNA, 25 bp, Rattus norvegicus
tttgttccttatttccttcaccacg

SEQ ID NO: 695721 - DNA, 25 bp, Rattus norvegicus
tttgttccttttcatattttggagg

SEQ ID NO: 695722 - DNA, 25 bp, Rattus norvegicus
tttgttccttttgatattttggagg

SEQ ID NO: 695723 - DNA, 25 bp, Rattus norvegicus
tttgttcgccatcccaattacttgg

SEQ ID NO: 695724 - DNA, 25 bp, Rattus norvegicus
tttgttcgccatgccaattacttgg

SEQ ID NO: 695725 - DNA, 25 bp, Rattus norvegicus
tttgttcggatgatgaagcgcttca

SEQ ID NO: 695726 - DNA, 25 bp, Rattus norvegicus
tttgttcggatgttgaagcgcttca

SEQ ID NO: 695727 - DNA, 25 bp, Rattus norvegicus
tttgttcgtttgcaaggcagggcta

SEQ ID NO: 695728 - DNA, 25 bp, Rattus norvegicus
tttgttcgtttggaaggcagggcta

SEQ ID NO: 695729 - DNA, 25 bp, Rattus norvegicus
tttgttctacccagaaacacagctc

SEQ ID NO: 695730 - DNA, 25 bp, Rattus norvegicus
tttgttctaccccttaagccttcag

SEQ ID NO: 695731 - DNA, 25 bp, Rattus norvegicus
tttgttctacccgttaagccttcag

SEQ ID NO: 695732 - DNA, 25 bp, Rattus norvegicus
tttgttctaccctgaaacacagctc

SEQ ID NO: 695733 - DNA, 25 bp, Rattus norvegicus
tttgttctatacatagcgccacact

SEQ ID NO: 695734 - DNA, 25 bp, Rattus norvegicus
tttgttctatacttagcgccacact

SEQ ID NO: 695735 - DNA, 25 bp, Rattus norvegicus
tttgttctatatccaccgagttgtt

SEQ ID NO: 695736 - DNA, 25 bp, Rattus norvegicus
tttgttctatatgcaccgagttgtt

SEQ ID NO: 695737 - DNA, 25 bp, Rattus norvegicus
tttgttctcgttcgaagtgcagctg

SEQ ID NO: 695738 - DNA, 25 bp, Rattus norvegicus
tttgttctcgttggaagtgcagctg

SEQ ID NO: 695739 - DNA, 25 bp, Rattus norvegicus
tttgttctctctcattttttaggga

SEQ ID NO: 695740 - DNA, 25 bp, Rattus norvegicus
tttgttctctctcgtaggccaagca

SEQ ID NO: 695741 - DNA, 25 bp, Rattus norvegicus
tttgttctctctgattttttaggga

SEQ ID NO: 695742 - DNA, 25 bp, Rattus norvegicus
tttgttctctctggtaggccaagca

SEQ ID NO: 695743 - DNA, 25 bp, Rattus norvegicus
tttgttctctggacctatctgagat

SEQ ID NO: 695744 - DNA, 25 bp, Rattus norvegicus
tttgttctctggtcctatctgagat

SEQ ID NO: 695745 - DNA, 25 bp, Rattus norvegicus
tttgttctcttgcaaacagggcctg

SEQ ID NO: 695746 - DNA, 25 bp, Rattus norvegicus
tttgttctcttggaaacagggcctg

SEQ ID NO: 695747 - DNA, 25 bp, Rattus norvegicus
tttgttctgaaccatcccagggcac

SEQ ID NO: 695748 - DNA, 25 bp, Rattus norvegicus
tttgttctgaacgatcccagggcac

SEQ ID NO: 695749 - DNA, 25 bp, Rattus norvegicus
tttgttctggacaggcacggttggt

SEQ ID NO: 695750 - DNA, 25 bp, Rattus norvegicus
tttgttctggactggcacggttggt

SEQ ID NO: 695751 - DNA, 25 bp, Rattus norvegicus
tttgttctgtaaagtgtcctttggt

SEQ ID NO: 695752 - DNA, 25 bp, Rattus norvegicus
tttgttctgtaatgtgtcctttggt

SEQ ID NO: 695753 - DNA, 25 bp, Rattus norvegicus
tttgttctgttaccaagttggcctc

SEQ ID NO: 695754 - DNA, 25 bp, Rattus norvegicus
tttgttctgttagcaagttggcctc

SEQ ID NO: 695755 - DNA, 25 bp, Rattus norvegicus
tttgttcttgatactctctctattg

SEQ ID NO: 695756 - DNA, 25 bp, Rattus norvegicus
tttgttcttgattctctctctattg

SEQ ID NO: 695757 - DNA, 25 bp, Rattus norvegicus
tttgttcttgctataatcatttgtt

SEQ ID NO: 695758 - DNA, 25 bp, Rattus norvegicus
tttgttcttgctttaatcatttgtt

SEQ ID NO: 695759 - DNA, 25 bp, Rattus norvegicus
tttgttcttggacggctctggaaac

SEQ ID NO: 695760 - DNA, 25 bp, Rattus norvegicus
tttgttcttggagggctctggaaac

SEQ ID NO: 695761 - DNA, 25 bp, Rattus norvegicus
tttgttgaactccactctggtcgtc

SEQ ID NO: 695762 - DNA, 25 bp, Rattus norvegicus
tttgttgaactcgactctggtcgtc

SEQ ID NO: 695763 - DNA, 25 bp, Rattus norvegicus
tttgttgaatataatgcctaactcg

SEQ ID NO: 695764 - DNA, 25 bp, Rattus norvegicus
tttgttgaatattatgcctaactcg

SEQ ID NO: 695765 - DNA, 25 bp, Rattus norvegicus
tttgttgacattctcaccagggcct

SEQ ID NO: 695766 - DNA, 25 bp, Rattus norvegicus
tttgttgacattgtcaccagggcct

SEQ ID NO: 695767 - DNA, 25 bp, Rattus norvegicus
tttgttgacctaacctgatgcctcg

SEQ ID NO: 695768 - DNA, 25 bp, Rattus norvegicus
tttgttgacctatcctgatgcctcg

SEQ ID NO: 695769 - DNA, 25 bp, Rattus norvegicus
tttgttgacgagctggtcacggctc

SEQ ID NO: 695770 - DNA, 25 bp, Rattus norvegicus
tttgttgacgaggtggtcacggctc

SEQ ID NO: 695771 - DNA, 25 bp, Rattus norvegicus
tttgttgagaatcccttccctcatt

SEQ ID NO: 695772 - DNA, 25 bp, Rattus norvegicus
tttgttgagaatgccttccctcatt

SEQ ID NO: 695773 - DNA, 25 bp, Rattus norvegicus
tttgttgagagacccagttggccgt

SEQ ID NO: 695774 - DNA, 25 bp, Rattus norvegicus
tttgttgagagagccagttggccgt

SEQ ID NO: 695775 - DNA, 25 bp, Rattus norvegicus
tttgttgaggacacacctgtcatct

SEQ ID NO: 695776 - DNA, 25 bp, Rattus norvegicus
tttgttgaggactcacctgtcatct

SEQ ID NO: 695777 - DNA, 25 bp, Rattus norvegicus
tttgttgagtcaatctttccccttt

SEQ ID NO: 695778 - DNA, 25 bp, Rattus norvegicus
tttgttgagtcattctttccccttt

SEQ ID NO: 695779 - DNA, 25 bp, Rattus norvegicus
tttgttgatcttcagccacacgctg

SEQ ID NO: 695780 - DNA, 25 bp, Rattus norvegicus
tttgttgatcttgagccacacgctg

SEQ ID NO: 695781 - DNA, 25 bp, Rattus norvegicus
tttgttgcacagagacacgcgagcc

SEQ ID NO: 695782 - DNA, 25 bp, Rattus norvegicus
tttgttgcacagtgacacgcgagcc

SEQ ID NO: 695783 - DNA, 25 bp, Rattus norvegicus
tttgttgcacgccacagcccactga

SEQ ID NO: 695784 - DNA, 25 bp, Rattus norvegicus
tttgttgcacgcgacagcccactga

SEQ ID NO: 695785 - DNA, 25 bp, Rattus norvegicus
tttgttgcctggactcgtattcagt

SEQ ID NO: 695786 - DNA, 25 bp, Rattus norvegicus
tttgttgcctggtctcgtattcagt

SEQ ID NO: 695787 - DNA, 25 bp, Rattus norvegicus
tttgttgcgcttctgtcatagtctc

SEQ ID NO: 695788 - DNA, 25 bp, Rattus norvegicus
tttgttgcgcttgtgtcatagtctc

SEQ ID NO: 695789 - DNA, 25 bp, Rattus norvegicus
tttgttgctggccatcagaagccat

SEQ ID NO: 695790 - DNA, 25 bp, Rattus norvegicus
tttgttgctggcgatcagaagccat

SEQ ID NO: 695791 - DNA, 25 bp, Rattus norvegicus
tttgttggaataactgaatttctgt

SEQ ID NO: 695792 - DNA, 25 bp, Rattus norvegicus
tttgttggaatatctgaatttctgt

SEQ ID NO: 695793 - DNA, 25 bp, Rattus norvegicus
tttgttggaggacccagctttggtt

SEQ ID NO: 695794 - DNA, 25 bp, Rattus norvegicus
tttgttggaggagccagctttggtt

SEQ ID NO: 695795 - DNA, 25 bp, Rattus norvegicus
tttgttggccctatgaaattctgca

SEQ ID NO: 695796 - DNA, 25 bp, Rattus norvegicus
tttgttggccctttgaaattctgca

SEQ ID NO: 695797 - DNA, 25 bp, Rattus norvegicus
tttgttggctacagcatccacggca

SEQ ID NO: 695798 - DNA, 25 bp, Rattus norvegicus
tttgttggctactgcatccacggca

SEQ ID NO: 695799 - DNA, 25 bp, Rattus norvegicus
tttgttggtattcggccactgcaga

SEQ ID NO: 695800 - DNA, 25 bp, Rattus norvegicus
tttgttggtattgggccactgcaga

SEQ ID NO: 695801 - DNA, 25 bp, Rattus norvegicus
tttgttggtggcctttctccagaca

SEQ ID NO: 695802 - DNA, 25 bp, Rattus norvegicus
tttgttggtggcgtttctccagaca

SEQ ID NO: 695803 - DNA, 25 bp, Rattus norvegicus
tttgttggttacatctctttgagac

SEQ ID NO: 695804 - DNA, 25 bp, Rattus norvegicus
tttgttggttacttctctttgagac

SEQ ID NO: 695805 - DNA, 25 bp, Rattus norvegicus
tttgttgtaaggattgtcagctcga

SEQ ID NO: 695806 - DNA, 25 bp, Rattus norvegicus
tttgttgtaaggtttgtcagctcga

SEQ ID NO: 695807 - DNA, 25 bp, Rattus norvegicus
tttgttgtacctactgtgttctgaa

SEQ ID NO: 695808 - DNA, 25 bp, Rattus norvegicus
tttgttgtaccttctgtgttctgaa

SEQ ID NO: 695809 - DNA, 25 bp, Rattus norvegicus
tttgttgtatttatgatgctggcac

SEQ ID NO: 695810 - DNA, 25 bp, Rattus norvegicus
tttgttgtatttttgatgctggcac

SEQ ID NO: 695811 - DNA, 25 bp, Rattus norvegicus
tttgttgtcacaccagcactgcaaa

SEQ ID NO: 695812 - DNA, 25 bp, Rattus norvegicus
tttgttgtcacagcagcactgcaaa

SEQ ID NO: 695813 - DNA, 25 bp, Rattus norvegicus
tttgttgtcatactgtctgtgccga

SEQ ID NO: 695814 - DNA, 25 bp, Rattus norvegicus
tttgttgtcatagtgtctgtgccga

SEQ ID NO: 695815 - DNA, 25 bp, Rattus norvegicus
tttgttgtgacaacgctcagaggga

SEQ ID NO: 695816 - DNA, 25 bp, Rattus norvegicus
tttgttgtgacatcgctcagaggga

SEQ ID NO: 695817 - DNA, 25 bp, Rattus norvegicus
tttgttgtgctgctggctgctctca

SEQ ID NO: 695818 - DNA, 25 bp, Rattus norvegicus
tttgttgtgctggtggctgctctca

SEQ ID NO: 695819 - DNA, 25 bp, Rattus norvegicus
tttgttgtgtgacctccttagacca

SEQ ID NO: 695820 - DNA, 25 bp, Rattus norvegicus
tttgttgtgtgagctccttagacca

SEQ ID NO: 695821 - DNA, 25 bp, Rattus norvegicus
tttgttgttcaactgctccctcctt

SEQ ID NO: 695822 - DNA, 25 bp, Rattus norvegicus
tttgttgttcaagtgctccctcctt

SEQ ID NO: 695823 - DNA, 25 bp, Rattus norvegicus
tttgttgttcgtctgtgttctatcc

SEQ ID NO: 695824 - DNA, 25 bp, Rattus norvegicus
tttgttgttcgtgtgtgttctatcc

SEQ ID NO: 695825 - DNA, 25 bp, Rattus norvegicus
tttgttgtttgcctagactagtcct

SEQ ID NO: 695826 - DNA, 25 bp, Rattus norvegicus
tttgttgtttgcgtagactagtcct

SEQ ID NO: 695827 - DNA, 25 bp, Rattus norvegicus
tttgtttactcactggtggcagccg

SEQ ID NO: 695828 - DNA, 25 bp, Rattus norvegicus
tttgtttactcagtggtggcagccg

SEQ ID NO: 695829 - DNA, 25 bp, Rattus norvegicus
tttgtttactgtctggccgatgtct

SEQ ID NO: 695830 - DNA, 25 bp, Rattus norvegicus
tttgtttactgtgtggccgatgtct

SEQ ID NO: 695831 - DNA, 25 bp, Rattus norvegicus
tttgtttataaacgtctccgacctg

SEQ ID NO: 695832 - DNA, 25 bp, Rattus norvegicus
tttgtttataaaggtctccgacctg

SEQ ID NO: 695833 - DNA, 25 bp, Rattus norvegicus
tttgtttatatcattctttccttct

SEQ ID NO: 695834 - DNA, 25 bp, Rattus norvegicus
tttgtttatatctttctttccttct

SEQ ID NO: 695835 - DNA, 25 bp, Rattus norvegicus
tttgtttatctgacttcattccttc

SEQ ID NO: 695836 - DNA, 25 bp, Rattus norvegicus
tttgtttatctgtcttcattccttc

SEQ ID NO: 695837 - DNA, 25 bp, Rattus norvegicus
tttgtttattctaggaggcctagaa

SEQ ID NO: 695838 - DNA, 25 bp, Rattus norvegicus
tttgtttattcttggaggcctagaa

SEQ ID NO: 695839 - DNA, 25 bp, Rattus norvegicus
tttgtttcacaaaggcaggttgctg

SEQ ID NO: 695840 - DNA, 25 bp, Rattus norvegicus
tttgtttcacaatggcaggttgctg

SEQ ID NO: 695841 - DNA, 25 bp, Rattus norvegicus
tttgtttcataacagtgcctgcccc

SEQ ID NO: 695842 - DNA, 25 bp, Rattus norvegicus
tttgtttcataagagtgcctgcccc

SEQ ID NO: 695843 - DNA, 25 bp, Rattus norvegicus
tttgtttcccagcaaccactggtca

SEQ ID NO: 695844 - DNA, 25 bp, Rattus norvegicus
tttgtttcccaggaaccactggtca

SEQ ID NO: 695845 - DNA, 25 bp, Rattus norvegicus
tttgtttcctctatgcctgctgtta

SEQ ID NO: 695846 - DNA, 25 bp, Rattus norvegicus
tttgtttcctctttgcctgctgtta

SEQ ID NO: 695847 - DNA, 25 bp, Rattus norvegicus
tttgtttctctcaccgattattgcc

SEQ ID NO: 695848 - DNA, 25 bp, Rattus norvegicus
tttgtttctctctccgattattgcc

SEQ ID NO: 695849 - DNA, 25 bp, Rattus norvegicus
tttgtttgatcacagagacgcccct

SEQ ID NO: 695850 - DNA, 25 bp, Rattus norvegicus
tttgtttgatcagagagacgcccct

SEQ ID NO: 695851 - DNA, 25 bp, Rattus norvegicus
tttgtttggaagagtgccctgtaaa

SEQ ID NO: 695852 - DNA, 25 bp, Rattus norvegicus
tttgtttggaagtgtgccctgtaaa

SEQ ID NO: 695853 - DNA, 25 bp, Rattus norvegicus
tttgtttggccaagagaaattgctc

SEQ ID NO: 695854 - DNA, 25 bp, Rattus norvegicus
tttgtttggccatgagaaattgctc

SEQ ID NO: 695855 - DNA, 25 bp, Rattus norvegicus
tttgtttgtagtattagtgactggg

SEQ ID NO: 695856 - DNA, 25 bp, Rattus norvegicus
tttgtttgtagttttagtgactggg

SEQ ID NO: 695857 - DNA, 25 bp, Rattus norvegicus
tttgtttgtcatattcgcttttaag

SEQ ID NO: 695858 - DNA, 25 bp, Rattus norvegicus
tttgtttgtcattttcgcttttaag

SEQ ID NO: 695859 - DNA, 25 bp, Rattus norvegicus
tttgtttgttataatgaccatgcca

SEQ ID NO: 695860 - DNA, 25 bp, Rattus norvegicus
tttgtttgttattatgaccatgcca

SEQ ID NO: 695861 - DNA, 25 bp, Rattus norvegicus
tttgtttgttggctggcatttcaca

SEQ ID NO: 695862 - DNA, 25 bp, Rattus norvegicus
tttgtttgttgggtggcatttcaca

SEQ ID NO: 695863 - DNA, 25 bp, Rattus norvegicus
tttgtttgtttcagctggcctccta

SEQ ID NO: 695864 - DNA, 25 bp, Rattus norvegicus
tttgtttgtttctgctggcctccta

SEQ ID NO: 695865 - DNA, 25 bp, Rattus norvegicus
tttgttttaacgaggagcttcacta

SEQ ID NO: 695866 - DNA, 25 bp, Rattus norvegicus
tttgttttaacgtggagcttcacta

SEQ ID NO: 695867 - DNA, 25 bp, Rattus norvegicus
tttgttttaagaacccgaaagcact

SEQ ID NO: 695868 - DNA, 25 bp, Rattus norvegicus
tttgttttaagatcccgaaagcact

SEQ ID NO: 695869 - DNA, 25 bp, Rattus norvegicus
tttgttttaagcaaggtggtcccag

SEQ ID NO: 695870 - DNA, 25 bp, Rattus norvegicus
tttgttttaagcatctcagtgggaa

SEQ ID NO: 695871 - DNA, 25 bp, Rattus norvegicus
tttgttttaagctaggtggtcccag

SEQ ID NO: 695872 - DNA, 25 bp, Rattus norvegicus
tttgttttaagcttctcagtgggaa

SEQ ID NO: 695873 - DNA, 25 bp, Rattus norvegicus
tttgttttattgatcttcttctggg

SEQ ID NO: 695874 - DNA, 25 bp, Rattus norvegicus
tttgttttattgttcttcttctggg

SEQ ID NO: 695875 - DNA, 25 bp, Rattus norvegicus
tttgttttcaccagtgtgctagtga

SEQ ID NO: 695876 - DNA, 25 bp, Rattus norvegicus
tttgttttcacctgtgtgctagtga

SEQ ID NO: 695877 - DNA, 25 bp, Rattus norvegicus
tttgttttcctgctctcctttgcct

SEQ ID NO: 695878 - DNA, 25 bp, Rattus norvegicus
tttgttttcctggtctcctttgcct

SEQ ID NO: 695879 - DNA, 25 bp, Rattus norvegicus
tttgttttccttagccactctaatt

SEQ ID NO: 695880 - DNA, 25 bp, Rattus norvegicus
tttgttttccttatgcagccgctca

SEQ ID NO: 695881 - DNA, 25 bp, Rattus norvegicus
tttgttttcctttgccactctaatt

SEQ ID NO: 695882 - DNA, 25 bp, Rattus norvegicus
tttgttttccttttgcagccgctca

SEQ ID NO: 695883 - DNA, 25 bp, Rattus norvegicus
tttgttttcgtgaacctactctgca

SEQ ID NO: 695884 - DNA, 25 bp, Rattus norvegicus
tttgttttcgtgtacctactctgca

SEQ ID NO: 695885 - DNA, 25 bp, Rattus norvegicus
tttgttttctccagacttctgacac

SEQ ID NO: 695886 - DNA, 25 bp, Rattus norvegicus
tttgttttctccagtgctgagcgct

SEQ ID NO: 695887 - DNA, 25 bp, Rattus norvegicus
tttgttttctcccttggcactggcc

SEQ ID NO: 695888 - DNA, 25 bp, Rattus norvegicus
tttgttttctccgttggcactggcc

SEQ ID NO: 695889 - DNA, 25 bp, Rattus norvegicus
tttgttttctcctgacttctgacac

SEQ ID NO: 695890 - DNA, 25 bp, Rattus norvegicus
tttgttttctcctgtgctgagcgct

SEQ ID NO: 695891 - DNA, 25 bp, Rattus norvegicus
tttgttttctctccttagcagtagg

SEQ ID NO: 695892 - DNA, 25 bp, Rattus norvegicus
tttgttttctctgcttagcagtagg

SEQ ID NO: 695893 - DNA, 25 bp, Rattus norvegicus
tttgttttctttctgtcccctagca

SEQ ID NO: 695894 - DNA, 25 bp, Rattus norvegicus
tttgttttctttgtgtcccctagca

SEQ ID NO: 695895 - DNA, 25 bp, Rattus norvegicus
tttgttttgcttccagctacagttc

SEQ ID NO: 695896 - DNA, 25 bp, Rattus norvegicus
tttgttttgcttgcagctacagttc

SEQ ID NO: 695897 - DNA, 25 bp, Rattus norvegicus
tttgttttggatattccgcagcctt

SEQ ID NO: 695898 - DNA, 25 bp, Rattus norvegicus
tttgttttggattttccgcagcctt

SEQ ID NO: 695899 - DNA, 25 bp, Rattus norvegicus
tttgttttggtgacaacggccacct

SEQ ID NO: 695900 - DNA, 25 bp, Rattus norvegicus
tttgttttggtgtcaacggccacct

SEQ ID NO: 695901 - DNA, 25 bp, Rattus norvegicus
tttgtttttacccatgatccgctat

SEQ ID NO: 695902 - DNA, 25 bp, Rattus norvegicus
tttgtttttaccgatgatccgctat

SEQ ID NO: 695903 - DNA, 25 bp, Rattus norvegicus
tttgtttttcaacaccaggctggcc

SEQ ID NO: 695904 - DNA, 25 bp, Rattus norvegicus
tttgtttttcaagaccaggctggcc

SEQ ID NO: 695905 - DNA, 25 bp, Rattus norvegicus
tttgtttttcacaccatcatctctt

SEQ ID NO: 695906 - DNA, 25 bp, Rattus norvegicus
tttgtttttcactccatcatctctt

SEQ ID NO: 695907 - DNA, 25 bp, Rattus norvegicus
tttgtttttcagatgggctcgctcc

SEQ ID NO: 695908 - DNA, 25 bp, Rattus norvegicus
tttgtttttcagttgggctcgctcc

SEQ ID NO: 695909 - DNA, 25 bp, Rattus norvegicus
tttgtttttccaacgccacatatgc

SEQ ID NO: 695910 - DNA, 25 bp, Rattus norvegicus
tttgtttttccatcgccacatatgc

SEQ ID NO: 695911 - DNA, 25 bp, Rattus norvegicus
tttgtttttcccagtgtgattgagt

SEQ ID NO: 695912 - DNA, 25 bp, Rattus norvegicus
tttgtttttccctgtgtgattgagt

SEQ ID NO: 695913 - DNA, 25 bp, Rattus norvegicus
tttgtttttcgtagggaagtcatgg

SEQ ID NO: 695914 - DNA, 25 bp, Rattus norvegicus
tttgtttttcgttgggaagtcatgg

SEQ ID NO: 695915 - DNA, 25 bp, Rattus norvegicus
tttgtttttggcatcatcctggtct

SEQ ID NO: 695916 - DNA, 25 bp, Rattus norvegicus
tttgtttttggcttcatcctggtct

SEQ ID NO: 695917 - DNA, 25 bp, Rattus norvegicus
tttgtttttggtctgaggtccttct

SEQ ID NO: 695918 - DNA, 25 bp, Rattus norvegicus
tttgtttttggtgtgaggtccttct

SEQ ID NO: 695919 - DNA, 25 bp, Rattus norvegicus
tttgtttttgtcaccctcttggctt

SEQ ID NO: 695920 - DNA, 25 bp, Rattus norvegicus
tttgtttttgtctccctcttggctt

SEQ ID NO: 695921 - DNA, 25 bp, Rattus norvegicus
tttgtttttgttccagccccaggca

SEQ ID NO: 695922 - DNA, 25 bp, Rattus norvegicus
tttgtttttgttgcagccccaggca

SEQ ID NO: 695923 - DNA, 25 bp, Rattus norvegicus
ttttaaaacctgcaagtgcttcgca

SEQ ID NO: 695924 - DNA, 25 bp, Rattus norvegicus
ttttaaaacctggaagtgcttcgca

SEQ ID NO: 695925 - DNA, 25 bp, Rattus norvegicus
ttttaaaactagcatgtgtccattg

SEQ ID NO: 695926 - DNA, 25 bp, Rattus norvegicus
ttttaaaactaggatgtgtccattg

SEQ ID NO: 695927 - DNA, 25 bp, Rattus norvegicus
ttttaaaactctaacctccgtcatg

SEQ ID NO: 695928 - DNA, 25 bp, Rattus norvegicus
ttttaaaactcttacctccgtcatg

SEQ ID NO: 695929 - DNA, 25 bp, Rattus norvegicus
ttttaaaagcagacccacccatgat

SEQ ID NO: 695930 - DNA, 25 bp, Rattus norvegicus
ttttaaaagcagtcccacccatgat

SEQ ID NO: 695931 - DNA, 25 bp, Rattus norvegicus
ttttaaaagccaacccaccgtgaca

SEQ ID NO: 695932 - DNA, 25 bp, Rattus norvegicus
ttttaaaagccatcccaccgtgaca

SEQ ID NO: 695933 - DNA, 25 bp, Rattus norvegicus
ttttaaacatagagtccctgctgcc

SEQ ID NO: 695934 - DNA, 25 bp, Rattus norvegicus
ttttaaacatagtgtccctgctgcc

SEQ ID NO: 695935 - DNA, 25 bp, Rattus norvegicus
ttttaaactgccagaagctggtagt

SEQ ID NO: 695936 - DNA, 25 bp, Rattus norvegicus
ttttaaactgccatggtcccaaagt

SEQ ID NO: 695937 - DNA, 25 bp, Rattus norvegicus
ttttaaactgcctgaagctggtagt

SEQ ID NO: 695938 - DNA, 25 bp, Rattus norvegicus
ttttaaactgccttggtcccaaagt

SEQ ID NO: 695939 - DNA, 25 bp, Rattus norvegicus
ttttaaactttcaggctaatgctaa

SEQ ID NO: 695940 - DNA, 25 bp, Rattus norvegicus
ttttaaactttctggctaatgctaa

SEQ ID NO: 695941 - DNA, 25 bp, Rattus norvegicus
ttttaaagagccacagtctgactga

SEQ ID NO: 695942 - DNA, 25 bp, Rattus norvegicus
ttttaaagagcctcagtctgactga

SEQ ID NO: 695943 - DNA, 25 bp, Rattus norvegicus
ttttaaagagttccttggccctgct

SEQ ID NO: 695944 - DNA, 25 bp, Rattus norvegicus
ttttaaagagttgcttggccctgct

SEQ ID NO: 695945 - DNA, 25 bp, Rattus norvegicus
ttttaaagattcacattcctccgcc

SEQ ID NO: 695946 - DNA, 25 bp, Rattus norvegicus
ttttaaagattctcattcctccgcc

SEQ ID NO: 695947 - DNA, 25 bp, Rattus norvegicus
ttttaaagcgccagctgcttgggta

SEQ ID NO: 695948 - DNA, 25 bp, Rattus norvegicus
ttttaaagcgcctgctgcttgggta

SEQ ID NO: 695949 - DNA, 25 bp, Rattus norvegicus
ttttaaatcattccctcctgtgtac

SEQ ID NO: 695950 - DNA, 25 bp, Rattus norvegicus
ttttaaatcattgcctcctgtgtac

SEQ ID NO: 695951 - DNA, 25 bp, Rattus norvegicus
ttttaaatccaacagccaggctgat

SEQ ID NO: 695952 - DNA, 25 bp, Rattus norvegicus
ttttaaatccaagagccaggctgat

SEQ ID NO: 695953 - DNA, 25 bp, Rattus norvegicus
ttttaaatcttgctgaccatggtca

SEQ ID NO: 695954 - DNA, 25 bp, Rattus norvegicus
ttttaaatcttggtgaccatggtca

SEQ ID NO: 695955 - DNA, 25 bp, Rattus norvegicus
ttttaaatgcccatgagtccgtcca

SEQ ID NO: 695956 - DNA, 25 bp, Rattus norvegicus
ttttaaatgcccttgagtccgtcca

SEQ ID NO: 695957 - DNA, 25 bp, Rattus norvegicus
ttttaaattcataccagtcagggtt

SEQ ID NO: 695958 - DNA, 25 bp, Rattus norvegicus
ttttaaattcattccagtcagggtt

SEQ ID NO: 695959 - DNA, 25 bp, Rattus norvegicus
ttttaaatttccaccaactagagat

SEQ ID NO: 695960 - DNA, 25 bp, Rattus norvegicus
ttttaaatttcctccaactagagat

SEQ ID NO: 695961 - DNA, 25 bp, Rattus norvegicus
ttttaacacaatatcctcctgtcct

SEQ ID NO: 695962 - DNA, 25 bp, Rattus norvegicus
ttttaacacaatccaggcagccgac

SEQ ID NO: 695963 - DNA, 25 bp, Rattus norvegicus
ttttaacacaatgcaggcagccgac

SEQ ID NO: 695964 - DNA, 25 bp, Rattus norvegicus
ttttaacacaatttcctcctgtcct

SEQ ID NO: 695965 - DNA, 25 bp, Rattus norvegicus
ttttaacacgatccatgtctggttt

SEQ ID NO: 695966 - DNA, 25 bp, Rattus norvegicus
ttttaacacgatgcatgtctggttt

SEQ ID NO: 695967 - DNA, 25 bp, Rattus norvegicus
ttttaacatttcacactgcctacgt

SEQ ID NO: 695968 - DNA, 25 bp, Rattus norvegicus
ttttaacatttctcactgcctacgt

SEQ ID NO: 695969 - DNA, 25 bp, Rattus norvegicus
ttttaaccatgtacttccagcaacc

SEQ ID NO: 695970 - DNA, 25 bp, Rattus norvegicus
ttttaaccatgttcttccagcaacc

SEQ ID NO: 695971 - DNA, 25 bp, Rattus norvegicus
ttttaaccctcaaattcggcctgat

SEQ ID NO: 695972 - DNA, 25 bp, Rattus norvegicus
ttttaaccctcatattcggcctgat

SEQ ID NO: 695973 - DNA, 25 bp, Rattus norvegicus
ttttaaccctgaaccaatggacact

SEQ ID NO: 695974 - DNA, 25 bp, Rattus norvegicus
ttttaaccctgatccaatggacact

SEQ ID NO: 695975 - DNA, 25 bp, Rattus norvegicus
ttttaacctccaacatctctgtata

SEQ ID NO: 695976 - DNA, 25 bp, Rattus norvegicus
ttttaacctccatcatctctgtata

SEQ ID NO: 695977 - DNA, 25 bp, Rattus norvegicus
ttttaacctctcaacttgcagcttt

SEQ ID NO: 695978 - DNA, 25 bp, Rattus norvegicus
ttttaacctctctacttgcagcttt

SEQ ID NO: 695979 - DNA, 25 bp, Rattus norvegicus
ttttaacctgagctgcctaatgcat

SEQ ID NO: 695980 - DNA, 25 bp, Rattus norvegicus
ttttaacctgaggtgcctaatgcat

SEQ ID NO: 695981 - DNA, 25 bp, Rattus norvegicus
ttttaacctttaccacaattctgtg

SEQ ID NO: 695982 - DNA, 25 bp, Rattus norvegicus
ttttaacctttagcacaattctgtg

SEQ ID NO: 695983 - DNA, 25 bp, Rattus norvegicus
ttttaactaattcttgtcgatggac

SEQ ID NO: 695984 - DNA, 25 bp, Rattus norvegicus
ttttaactaattgttgtcgatggac

SEQ ID NO: 695985 - DNA, 25 bp, Rattus norvegicus
ttttaactacacactaccatgggcc

SEQ ID NO: 695986 - DNA, 25 bp, Rattus norvegicus
ttttaactacactctaccatgggcc

SEQ ID NO: 695987 - DNA, 25 bp, Rattus norvegicus
ttttaactctaccactacgtctagc

SEQ ID NO: 695988 - DNA, 25 bp, Rattus norvegicus
ttttaactctacgactacgtctagc

SEQ ID NO: 695989 - DNA, 25 bp, Rattus norvegicus
ttttaactctttcctgactttgatg

SEQ ID NO: 695990 - DNA, 25 bp, Rattus norvegicus
ttttaactctttgctgactttgatg

SEQ ID NO: 695991 - DNA, 25 bp, Rattus norvegicus
ttttaactggttctccaagtcgcca

SEQ ID NO: 695992 - DNA, 25 bp, Rattus norvegicus
ttttaactggttgtccaagtcgcca

SEQ ID NO: 695993 - DNA, 25 bp, Rattus norvegicus
ttttaacttctcctcatgtggctat

SEQ ID NO: 695994 - DNA, 25 bp, Rattus norvegicus
ttttaacttctcgtcatgtggctat

SEQ ID NO: 695995 - DNA, 25 bp, Rattus norvegicus
ttttaactttaacccacctggtctg

SEQ ID NO: 695996 - DNA, 25 bp, Rattus norvegicus
ttttaactttaagccacctggtctg

SEQ ID NO: 695997 - DNA, 25 bp, Rattus norvegicus
ttttaagaacatctctagatgcata

SEQ ID NO: 695998 - DNA, 25 bp, Rattus norvegicus
ttttaagaacatgtctagatgcata

SEQ ID NO: 695999 - DNA, 25 bp, Rattus norvegicus
ttttaagacgctagctggccaccaa

SEQ ID NO: 696000 - DNA, 25 bp, Rattus norvegicus
ttttaagacgcttgctggccaccaa

SEQ ID NO: 696001 - DNA, 25 bp, Rattus norvegicus
ttttaagactccacttgctgagctg

SEQ ID NO: 696002 - DNA, 25 bp, Rattus norvegicus
ttttaagactcctcttgctgagctg

SEQ ID NO: 696003 - DNA, 25 bp, Rattus norvegicus
ttttaagattctcctcagttccacc

SEQ ID NO: 696004 - DNA, 25 bp, Rattus norvegicus
ttttaagattctgctcagttccacc

SEQ ID NO: 696005 - DNA, 25 bp, Rattus norvegicus
ttttaagcaagtccggctcctcaaa

SEQ ID NO: 696006 - DNA, 25 bp, Rattus norvegicus
ttttaagcaagtgcggctcctcaaa

SEQ ID NO: 696007 - DNA, 25 bp, Rattus norvegicus
ttttaagcagagacaaccctgacct

SEQ ID NO: 696008 - DNA, 25 bp, Rattus norvegicus
ttttaagcagagtcaaccctgacct

SEQ ID NO: 696009 - DNA, 25 bp, Rattus norvegicus
ttttaagccaatctgcacttctagg

SEQ ID NO: 696010 - DNA, 25 bp, Rattus norvegicus
ttttaagccaatgtgcacttctagg

SEQ ID NO: 696011 - DNA, 25 bp, Rattus norvegicus
ttttaagcctctcacatacatttgt

SEQ ID NO: 696012 - DNA, 25 bp, Rattus norvegicus
ttttaagcctctgacatacatttgt

SEQ ID NO: 696013 - DNA, 25 bp, Rattus norvegicus
ttttaagccttaactcgccattgat

SEQ ID NO: 696014 - DNA, 25 bp, Rattus norvegicus
ttttaagccttatctcgccattgat

SEQ ID NO: 696015 - DNA, 25 bp, Rattus norvegicus
ttttaagcgggtcctaagatccaag

SEQ ID NO: 696016 - DNA, 25 bp, Rattus norvegicus
ttttaagcgggtgctaagatccaag

SEQ ID NO: 696017 - DNA, 25 bp, Rattus norvegicus
ttttaagctgccagtgatatgtccg

SEQ ID NO: 696018 - DNA, 25 bp, Rattus norvegicus
ttttaagctgcctgtgatatgtccg

SEQ ID NO: 696019 - DNA, 25 bp, Rattus norvegicus
ttttaaggcatccttctccctaagg

SEQ ID NO: 696020 - DNA, 25 bp, Rattus norvegicus
ttttaaggcatcgttctccctaagg

SEQ ID NO: 696021 - DNA, 25 bp, Rattus norvegicus
ttttaaggcctcatgttctttgaat

SEQ ID NO: 696022 - DNA, 25 bp, Rattus norvegicus
ttttaaggcctcttgttctttgaat

SEQ ID NO: 696023 - DNA, 25 bp, Rattus norvegicus
ttttaaggcgggagtcatggctctg

SEQ ID NO: 696024 - DNA, 25 bp, Rattus norvegicus
ttttaaggcgggtgtcatggctctg

SEQ ID NO: 696025 - DNA, 25 bp, Rattus norvegicus
ttttaagggacacgttgggatctca

SEQ ID NO: 696026 - DNA, 25 bp, Rattus norvegicus
ttttaagggacaggttgggatctca

SEQ ID NO: 696027 - DNA, 25 bp, Rattus norvegicus
ttttaaggtgtacaccatcgaaaga

SEQ ID NO: 696028 - DNA, 25 bp, Rattus norvegicus
ttttaaggtgtagaccatcgaaaga

SEQ ID NO: 696029 - DNA, 25 bp, Rattus norvegicus
ttttaagtatccctggagttgggag

SEQ ID NO: 696030 - DNA, 25 bp, Rattus norvegicus
ttttaagtatccgtggagttgggag

SEQ ID NO: 696031 - DNA, 25 bp, Rattus norvegicus
ttttaagtcagaagcagaagtgggc

SEQ ID NO: 696032 - DNA, 25 bp, Rattus norvegicus
ttttaagtcagatgcagaagtgggc

SEQ ID NO: 696033 - DNA, 25 bp, Rattus norvegicus
ttttaagtcttcacatagctttgga

SEQ ID NO: 696034 - DNA, 25 bp, Rattus norvegicus
ttttaagtcttctcatagctttgga

SEQ ID NO: 696035 - DNA, 25 bp, Rattus norvegicus
ttttaagtttgcactacagcacaga

SEQ ID NO: 696036 - DNA, 25 bp, Rattus norvegicus
ttttaagtttgctctacagcacaga

SEQ ID NO: 696037 - DNA, 25 bp, Rattus norvegicus
ttttaatactatctttttctccgag

SEQ ID NO: 696038 - DNA, 25 bp, Rattus norvegicus
ttttaatactatgtttttctccgag

SEQ ID NO: 696039 - DNA, 25 bp, Rattus norvegicus
ttttaatatcctagagcctgggcaa

SEQ ID NO: 696040 - DNA, 25 bp, Rattus norvegicus
ttttaatatcctccctatcaatcac

SEQ ID NO: 696041 - DNA, 25 bp, Rattus norvegicus
ttttaatatcctgcctatcaatcac

SEQ ID NO: 696042 - DNA, 25 bp, Rattus norvegicus
ttttaatatccttgagcctgggcaa

SEQ ID NO: 696043 - DNA, 25 bp, Rattus norvegicus
ttttaatcactacccaactgttgtt

SEQ ID NO: 696044 - DNA, 25 bp, Rattus norvegicus
ttttaatcactagccaactgttgtt

SEQ ID NO: 696045 - DNA, 25 bp, Rattus norvegicus
ttttaatcacttagccacatacggt

SEQ ID NO: 696046 - DNA, 25 bp, Rattus norvegicus
ttttaatcactttgccacatacggt

SEQ ID NO: 696047 - DNA, 25 bp, Rattus norvegicus
ttttaatccatgaaatgtgttgcct

SEQ ID NO: 696048 - DNA, 25 bp, Rattus norvegicus
ttttaatccatgtaatgtgttgcct

SEQ ID NO: 696049 - DNA, 25 bp, Rattus norvegicus
ttttaatcgacaattccctgctagg

SEQ ID NO: 696050 - DNA, 25 bp, Rattus norvegicus
ttttaatcgacatttccctgctagg

SEQ ID NO: 696051 - DNA, 25 bp, Rattus norvegicus
ttttaatctaccaattgctcctgac

SEQ ID NO: 696052 - DNA, 25 bp, Rattus norvegicus
ttttaatctacctattgctcctgac

SEQ ID NO: 696053 - DNA, 25 bp, Rattus norvegicus
ttttaatctctcagaagcccagcac

SEQ ID NO: 696054 - DNA, 25 bp, Rattus norvegicus
ttttaatctctctgaagcccagcac

SEQ ID NO: 696055 - DNA, 25 bp, Rattus norvegicus
ttttaatgcttgaggactgcagtcc

SEQ ID NO: 696056 - DNA, 25 bp, Rattus norvegicus
ttttaatgcttgtggactgcagtcc

SEQ ID NO: 696057 - DNA, 25 bp, Rattus norvegicus
ttttaatgtaacaccacaccccatg

SEQ ID NO: 696058 - DNA, 25 bp, Rattus norvegicus
ttttaatgtaactccacaccccatg

SEQ ID NO: 696059 - DNA, 25 bp, Rattus norvegicus
ttttaattcagtagctacccttcct

SEQ ID NO: 696060 - DNA, 25 bp, Rattus norvegicus
ttttaattcagttgctacccttcct

SEQ ID NO: 696061 - DNA, 25 bp, Rattus norvegicus
ttttaattccttcggcatggttgcc

SEQ ID NO: 696062 - DNA, 25 bp, Rattus norvegicus
ttttaattccttgggcatggttgcc

SEQ ID NO: 696063 - DNA, 25 bp, Rattus norvegicus
ttttaattgtttactccggagcagt

SEQ ID NO: 696064 - DNA, 25 bp, Rattus norvegicus
ttttaattgttttctccggagcagt

SEQ ID NO: 696065 - DNA, 25 bp, Rattus norvegicus
ttttacaacattctgcttgcttttg

SEQ ID NO: 696066 - DNA, 25 bp, Rattus norvegicus
ttttacaacattgtgcttgcttttg

SEQ ID NO: 696067 - DNA, 25 bp, Rattus norvegicus
ttttacaactccaggagtccagctg

SEQ ID NO: 696068 - DNA, 25 bp, Rattus norvegicus
ttttacaactcctggagtccagctg

SEQ ID NO: 696069 - DNA, 25 bp, Rattus norvegicus
ttttacaagaacactgccagccatc

SEQ ID NO: 696070 - DNA, 25 bp, Rattus norvegicus
ttttacaagaactctgccagccatc

SEQ ID NO: 696071 - DNA, 25 bp, Rattus norvegicus
ttttacaatgaaagtttccaggatg

SEQ ID NO: 696072 - DNA, 25 bp, Rattus norvegicus
ttttacaatgaactgcagccctgga

SEQ ID NO: 696073 - DNA, 25 bp, Rattus norvegicus
ttttacaatgaagtgcagccctgga

SEQ ID NO: 696074 - DNA, 25 bp, Rattus norvegicus
ttttacaatgaatgtttccaggatg

SEQ ID NO: 696075 - DNA, 25 bp, Rattus norvegicus
ttttacacagcgctcttatttatat

SEQ ID NO: 696076 - DNA, 25 bp, Rattus norvegicus
ttttacacagcggtcttatttatat

SEQ ID NO: 696077 - DNA, 25 bp, Rattus norvegicus
ttttacacatgtatggcaacaccag

SEQ ID NO: 696078 - DNA, 25 bp, Rattus norvegicus
ttttacacatgtttggcaacaccag

SEQ ID NO: 696079 - DNA, 25 bp, Rattus norvegicus
ttttacaccgtgaagcctgtcaagg

SEQ ID NO: 696080 - DNA, 25 bp, Rattus norvegicus
ttttacaccgtgtagcctgtcaagg

SEQ ID NO: 696081 - DNA, 25 bp, Rattus norvegicus
ttttacacctttcgctatgcgctaa

SEQ ID NO: 696082 - DNA, 25 bp, Rattus norvegicus
ttttacacctttggctatgcgctaa

SEQ ID NO: 696083 - DNA, 25 bp, Rattus norvegicus
ttttacacgcatctcagcttagtct

SEQ ID NO: 696084 - DNA, 25 bp, Rattus norvegicus
ttttacacgcatgtcagcttagtct

SEQ ID NO: 696085 - DNA, 25 bp, Rattus norvegicus
ttttacactgtgatttactcactgg

SEQ ID NO: 696086 - DNA, 25 bp, Rattus norvegicus
ttttacactgtgttttactcactgg

SEQ ID NO: 696087 - DNA, 25 bp, Rattus norvegicus
ttttacagacctagtgtcctcagtc

SEQ ID NO: 696088 - DNA, 25 bp, Rattus norvegicus
ttttacagaccttgtgtcctcagtc

SEQ ID NO: 696089 - DNA, 25 bp, Rattus norvegicus
ttttacagagaacccggcttctagt

SEQ ID NO: 696090 - DNA, 25 bp, Rattus norvegicus
ttttacagagaagccggcttctagt

SEQ ID NO: 696091 - DNA, 25 bp, Rattus norvegicus
ttttacagatcgctggccttggttc

SEQ ID NO: 696092 - DNA, 25 bp, Rattus norvegicus
ttttacagatcggtggccttggttc

SEQ ID NO: 696093 - DNA, 25 bp, Rattus norvegicus
ttttacaggctactaccttggtctt

SEQ ID NO: 696094 - DNA, 25 bp, Rattus norvegicus
ttttacaggctagtaccttggtctt

SEQ ID NO: 696095 - DNA, 25 bp, Rattus norvegicus
ttttacagtccaagggaacgcctct

SEQ ID NO: 696096 - DNA, 25 bp, Rattus norvegicus
ttttacagtccatgggaacgcctct

SEQ ID NO: 696097 - DNA, 25 bp, Rattus norvegicus
ttttacagtttcaaaccccacatca

SEQ ID NO: 696098 - DNA, 25 bp, Rattus norvegicus
ttttacagtttctaaccccacatca

SEQ ID NO: 696099 - DNA, 25 bp, Rattus norvegicus
ttttacatacacatataatactgat

SEQ ID NO: 696100 - DNA, 25 bp, Rattus norvegicus
ttttacatacacttataatactgat

SEQ ID NO: 696101 - DNA, 25 bp, Rattus norvegicus
ttttacatatctagtgctcccctac

SEQ ID NO: 696102 - DNA, 25 bp, Rattus norvegicus
ttttacatatcttgtgctcccctac

SEQ ID NO: 696103 - DNA, 25 bp, Rattus norvegicus
ttttacatctccattccttattcca

SEQ ID NO: 696104 - DNA, 25 bp, Rattus norvegicus
ttttacatctcctttccttattcca

SEQ ID NO: 696105 - DNA, 25 bp, Rattus norvegicus
ttttacatgtccacagctcctaatc

SEQ ID NO: 696106 - DNA, 25 bp, Rattus norvegicus
ttttacatgtcctcagctcctaatc

SEQ ID NO: 696107 - DNA, 25 bp, Rattus norvegicus
ttttacattgtcaggcaatccacag

SEQ ID NO: 696108 - DNA, 25 bp, Rattus norvegicus
ttttacattgtctggcaatccacag

SEQ ID NO: 696109 - DNA, 25 bp, Rattus norvegicus
ttttaccaccctaccaagtgctagg

SEQ ID NO: 696110 - DNA, 25 bp, Rattus norvegicus
ttttaccacccttccaagtgctagg

SEQ ID NO: 696111 - DNA, 25 bp, Rattus norvegicus
ttttaccagctaacaagacgtcgag

SEQ ID NO: 696112 - DNA, 25 bp, Rattus norvegicus
ttttaccagctatcaagacgtcgag

SEQ ID NO: 696113 - DNA, 25 bp, Rattus norvegicus
ttttacccactgctaaagtcttgtg

SEQ ID NO: 696114 - DNA, 25 bp, Rattus norvegicus
ttttacccactggtaaagtcttgtg

SEQ ID NO: 696115 - DNA, 25 bp, Rattus norvegicus
ttttacccttccagtaagacagtag

SEQ ID NO: 696116 - DNA, 25 bp, Rattus norvegicus
ttttacccttcctgtaagacagtag

SEQ ID NO: 696117 - DNA, 25 bp, Rattus norvegicus
ttttacctacatccatgcctgcctt

SEQ ID NO: 696118 - DNA, 25 bp, Rattus norvegicus
ttttacctacatgcatgcctgcctt

SEQ ID NO: 696119 - DNA, 25 bp, Rattus norvegicus
ttttacctactaagccgtcttgcca

SEQ ID NO: 696120 - DNA, 25 bp, Rattus norvegicus
ttttacctactatgccgtcttgcca

SEQ ID NO: 696121 - DNA, 25 bp, Rattus norvegicus
ttttacctcaagaccaatactctct

SEQ ID NO: 696122 - DNA, 25 bp, Rattus norvegicus
ttttacctcaagtccaatactctct

SEQ ID NO: 696123 - DNA, 25 bp, Rattus norvegicus
ttttacctcagtacgtttgtgtttg

SEQ ID NO: 696124 - DNA, 25 bp, Rattus norvegicus
ttttacctcagttcgtttgtgtttg

SEQ ID NO: 696125 - DNA, 25 bp, Rattus norvegicus
ttttacctccggagacagaaggacg

SEQ ID NO: 696126 - DNA, 25 bp, Rattus norvegicus
ttttacctccggtgacagaaggacg

SEQ ID NO: 696127 - DNA, 25 bp, Rattus norvegicus
ttttaccttcacagacttgggccga

SEQ ID NO: 696128 - DNA, 25 bp, Rattus norvegicus
ttttaccttcactgacttgggccga

SEQ ID NO: 696129 - DNA, 25 bp, Rattus norvegicus
ttttaccttgatcggcttcttggca

SEQ ID NO: 696130 - DNA, 25 bp, Rattus norvegicus
ttttaccttgatgggcttcttggca

SEQ ID NO: 696131 - DNA, 25 bp, Rattus norvegicus
ttttaccttgtgagtgataatctgg

SEQ ID NO: 696132 - DNA, 25 bp, Rattus norvegicus
ttttaccttgtgtgtgataatctgg

SEQ ID NO: 696133 - DNA, 25 bp, Rattus norvegicus
ttttacctttctactaaactgcaag

SEQ ID NO: 696134 - DNA, 25 bp, Rattus norvegicus
ttttacctttcttctaaactgcaag

SEQ ID NO: 696135 - DNA, 25 bp, Rattus norvegicus
ttttacggacctcggtctgccaaga

SEQ ID NO: 696136 - DNA, 25 bp, Rattus norvegicus
ttttacggacctgggtctgccaaga

SEQ ID NO: 696137 - DNA, 25 bp, Rattus norvegicus
ttttactatattacagaggctccta

SEQ ID NO: 696138 - DNA, 25 bp, Rattus norvegicus
ttttactatatttcagaggctccta

SEQ ID NO: 696139 - DNA, 25 bp, Rattus norvegicus
ttttactatttccagcaaacccgct

SEQ ID NO: 696140 - DNA, 25 bp, Rattus norvegicus
ttttactatttcgagcaaacccgct

SEQ ID NO: 696141 - DNA, 25 bp, Rattus norvegicus
ttttactcaagcccccttggagaag

SEQ ID NO: 696142 - DNA, 25 bp, Rattus norvegicus
ttttactcaagcctacctgatacag

SEQ ID NO: 696143 - DNA, 25 bp, Rattus norvegicus
ttttactcaagcgcccttggagaag

SEQ ID NO: 696144 - DNA, 25 bp, Rattus norvegicus
ttttactcaagcgtacctgatacag

SEQ ID NO: 696145 - DNA, 25 bp, Rattus norvegicus
ttttactcatcgctgctgctgtgga

SEQ ID NO: 696146 - DNA, 25 bp, Rattus norvegicus
ttttactcatcggtgctgctgtgga

SEQ ID NO: 696147 - DNA, 25 bp, Rattus norvegicus
ttttactcatttcctagcatgcact

SEQ ID NO: 696148 - DNA, 25 bp, Rattus norvegicus
ttttactcatttgctagcatgcact

SEQ ID NO: 696149 - DNA, 25 bp, Rattus norvegicus
ttttactccagcctttgtcagcact

SEQ ID NO: 696150 - DNA, 25 bp, Rattus norvegicus
ttttactccagcgtttgtcagcact

SEQ ID NO: 696151 - DNA, 25 bp, Rattus norvegicus
ttttactcccttaataggaagcaag

SEQ ID NO: 696152 - DNA, 25 bp, Rattus norvegicus
ttttactccctttataggaagcaag

SEQ ID NO: 696153 - DNA, 25 bp, Rattus norvegicus
ttttactctcaaaactggcccagtg

SEQ ID NO: 696154 - DNA, 25 bp, Rattus norvegicus
ttttactctcaatactggcccagtg

SEQ ID NO: 696155 - DNA, 25 bp, Rattus norvegicus
ttttactgctctatcgaactgtgga

SEQ ID NO: 696156 - DNA, 25 bp, Rattus norvegicus
ttttactgctctttcgaactgtgga

SEQ ID NO: 696157 - DNA, 25 bp, Rattus norvegicus
ttttactgtgccatgcttagagcca

SEQ ID NO: 696158 - DNA, 25 bp, Rattus norvegicus
ttttactgtgccttgcttagagcca

SEQ ID NO: 696159 - DNA, 25 bp, Rattus norvegicus
ttttactgtggccaatcagcgttcg

SEQ ID NO: 696160 - DNA, 25 bp, Rattus norvegicus
ttttactgtggcgaatcagcgttcg

SEQ ID NO: 696161 - DNA, 25 bp, Rattus norvegicus
ttttactgtgggatcggcttccatt

SEQ ID NO: 696162 - DNA, 25 bp, Rattus norvegicus
ttttactgtgggttcggcttccatt

SEQ ID NO: 696163 - DNA, 25 bp, Rattus norvegicus
ttttactgttgccttgaatccctga

SEQ ID NO: 696164 - DNA, 25 bp, Rattus norvegicus
ttttactgttgcgttgaatccctga

SEQ ID NO: 696165 - DNA, 25 bp, Rattus norvegicus
ttttacttaaggcattagggcatat

SEQ ID NO: 696166 - DNA, 25 bp, Rattus norvegicus
ttttacttaagggattagggcatat

SEQ ID NO: 696167 - DNA, 25 bp, Rattus norvegicus
ttttacttcaacaagcccacaggct

SEQ ID NO: 696168 - DNA, 25 bp, Rattus norvegicus
ttttacttcaactagcccacaggct

SEQ ID NO: 696169 - DNA, 25 bp, Rattus norvegicus
ttttacttcatcctgtgtttcccct

SEQ ID NO: 696170 - DNA, 25 bp, Rattus norvegicus
ttttacttcatcgtgtgtttcccct

SEQ ID NO: 696171 - DNA, 25 bp, Rattus norvegicus
ttttacttctacagatgccccattc

SEQ ID NO: 696172 - DNA, 25 bp, Rattus norvegicus
ttttacttctacagggtggttctgg

SEQ ID NO: 696173 - DNA, 25 bp, Rattus norvegicus
ttttacttctactgatgccccattc

SEQ ID NO: 696174 - DNA, 25 bp, Rattus norvegicus
ttttacttctactgggtggttctgg

SEQ ID NO: 696175 - DNA, 25 bp, Rattus norvegicus
ttttacttgcccctacgattgtaca

SEQ ID NO: 696176 - DNA, 25 bp, Rattus norvegicus
ttttacttgcccgtacgattgtaca

SEQ ID NO: 696177 - DNA, 25 bp, Rattus norvegicus
ttttacttggctacttgacatccca

SEQ ID NO: 696178 - DNA, 25 bp, Rattus norvegicus
ttttacttggcttcttgacatccca

SEQ ID NO: 696179 - DNA, 25 bp, Rattus norvegicus
ttttacttgggaaagggcctcacct

SEQ ID NO: 696180 - DNA, 25 bp, Rattus norvegicus
ttttacttgggatagggcctcacct

SEQ ID NO: 696181 - DNA, 25 bp, Rattus norvegicus
ttttactttgcaaattaggccctat

SEQ ID NO: 696182 - DNA, 25 bp, Rattus norvegicus
ttttactttgcatattaggccctat

SEQ ID NO: 696183 - DNA, 25 bp, Rattus norvegicus
ttttactttgcgcatatttctccag

SEQ ID NO: 696184 - DNA, 25 bp, Rattus norvegicus
ttttactttgcggatatttctccag

SEQ ID NO: 696185 - DNA, 25 bp, Rattus norvegicus
ttttagaacacccacccttgggcat

SEQ ID NO: 696186 - DNA, 25 bp, Rattus norvegicus
ttttagaacaccgacccttgggcat

SEQ ID NO: 696187 - DNA, 25 bp, Rattus norvegicus
ttttagaacagtcttggccacctgc

SEQ ID NO: 696188 - DNA, 25 bp, Rattus norvegicus
ttttagaacagtgttggccacctgc

SEQ ID NO: 696189 - DNA, 25 bp, Rattus norvegicus
ttttagaacccacaagcatagcctt

SEQ ID NO: 696190 - DNA, 25 bp, Rattus norvegicus
ttttagaacccagaagcatagcctt

SEQ ID NO: 696191 - DNA, 25 bp, Rattus norvegicus
ttttagacccttactttgtgccaag

SEQ ID NO: 696192 - DNA, 25 bp, Rattus norvegicus
ttttagaccctttctttgtgccaag

SEQ ID NO: 696193 - DNA, 25 bp, Rattus norvegicus
ttttagaccttcatgacctggctga

SEQ ID NO: 696194 - DNA, 25 bp, Rattus norvegicus
ttttagaccttcttgacctggctga

SEQ ID NO: 696195 - DNA, 25 bp, Rattus norvegicus
ttttagacgaatccccgttcctctg

SEQ ID NO: 696196 - DNA, 25 bp, Rattus norvegicus
ttttagacgaatgcccgttcctctg

SEQ ID NO: 696197 - DNA, 25 bp, Rattus norvegicus
ttttagactctcaggtgcatgtatg

SEQ ID NO: 696198 - DNA, 25 bp, Rattus norvegicus
ttttagactctctggtgcatgtatg

SEQ ID NO: 696199 - DNA, 25 bp, Rattus norvegicus
ttttagaggtccaccccgtgacgct

SEQ ID NO: 696200 - DNA, 25 bp, Rattus norvegicus
ttttagaggtcctccccgtgacgct

SEQ ID NO: 696201 - DNA, 25 bp, Rattus norvegicus
ttttagagtcatacttctgcctccc

SEQ ID NO: 696202 - DNA, 25 bp, Rattus norvegicus
ttttagagtcattcttctgcctccc

SEQ ID NO: 696203 - DNA, 25 bp, Rattus norvegicus
ttttagatctttacattccccgtct

SEQ ID NO: 696204 - DNA, 25 bp, Rattus norvegicus
ttttagatcttttcattccccgtct

SEQ ID NO: 696205 - DNA, 25 bp, Rattus norvegicus
ttttagatgtgtcgtctctccttgt

SEQ ID NO: 696206 - DNA, 25 bp, Rattus norvegicus
ttttagatgtgtggtctctccttgt

SEQ ID NO: 696207 - DNA, 25 bp, Rattus norvegicus
ttttagcaaaacaacagccccactg

SEQ ID NO: 696208 - DNA, 25 bp, Rattus norvegicus
ttttagcaaaactacagccccactg

SEQ ID NO: 696209 - DNA, 25 bp, Rattus norvegicus
ttttagcaagcccacatctttctag

SEQ ID NO: 696210 - DNA, 25 bp, Rattus norvegicus
ttttagcaagccgacatctttctag

SEQ ID NO: 696211 - DNA, 25 bp, Rattus norvegicus
ttttagcacagccaggtccggacct

SEQ ID NO: 696212 - DNA, 25 bp, Rattus norvegicus
ttttagcacagcgaggtccggacct

SEQ ID NO: 696213 - DNA, 25 bp, Rattus norvegicus
ttttagcaggtcatgggcgatccaa

SEQ ID NO: 696214 - DNA, 25 bp, Rattus norvegicus
ttttagcaggtcttgggcgatccaa

SEQ ID NO: 696215 - DNA, 25 bp, Rattus norvegicus
ttttagcagttgaattccagaccag

SEQ ID NO: 696216 - DNA, 25 bp, Rattus norvegicus
ttttagcagttgtattccagaccag

SEQ ID NO: 696217 - DNA, 25 bp, Rattus norvegicus
ttttagccactacaactcagcctgt

SEQ ID NO: 696218 - DNA, 25 bp, Rattus norvegicus
ttttagccactagaactcagcctgt

SEQ ID NO: 696219 - DNA, 25 bp, Rattus norvegicus
ttttagccagataggatccagcccc

SEQ ID NO: 696220 - DNA, 25 bp, Rattus norvegicus
ttttagccagattggatccagcccc

SEQ ID NO: 696221 - DNA, 25 bp, Rattus norvegicus
ttttagccattcactgccttcaatt

SEQ ID NO: 696222 - DNA, 25 bp, Rattus norvegicus
ttttagccattctctgccttcaatt

SEQ ID NO: 696223 - DNA, 25 bp, Rattus norvegicus
ttttagcccacccacgcttaacata

SEQ ID NO: 696224 - DNA, 25 bp, Rattus norvegicus
ttttagcccaccgacgcttaacata

SEQ ID NO: 696225 - DNA, 25 bp, Rattus norvegicus
ttttagcctaagaacatcttcctcc

SEQ ID NO: 696226 - DNA, 25 bp, Rattus norvegicus
ttttagcctaagtacatcttcctcc

SEQ ID NO: 696227 - DNA, 25 bp, Rattus norvegicus
ttttagcctatcatatctgcctact

SEQ ID NO: 696228 - DNA, 25 bp, Rattus norvegicus
ttttagcctatcttatctgcctact

SEQ ID NO: 696229 - DNA, 25 bp, Rattus norvegicus
ttttagcctggaaggctgcagccca

SEQ ID NO: 696230 - DNA, 25 bp, Rattus norvegicus
ttttagcctggatggctgcagccca

SEQ ID NO: 696231 - DNA, 25 bp, Rattus norvegicus
ttttagccttttcccatcatgtaat

SEQ ID NO: 696232 - DNA, 25 bp, Rattus norvegicus
ttttagccttttgccatcatgtaat

SEQ ID NO: 696233 - DNA, 25 bp, Rattus norvegicus
ttttagctctcaattctacggcatg

SEQ ID NO: 696234 - DNA, 25 bp, Rattus norvegicus
ttttagctctcatttctacggcatg

SEQ ID NO: 696235 - DNA, 25 bp, Rattus norvegicus
ttttagctgctgagctcgtgggcgt

SEQ ID NO: 696236 - DNA, 25 bp, Rattus norvegicus
ttttagctgctgtgctcgtgggcgt

SEQ ID NO: 696237 - DNA, 25 bp, Rattus norvegicus
ttttagcttgttattcccatgcccc

SEQ ID NO: 696238 - DNA, 25 bp, Rattus norvegicus
ttttagcttgtttttcccatgcccc

SEQ ID NO: 696239 - DNA, 25 bp, Rattus norvegicus
ttttaggaactgcaaacactgaaat

SEQ ID NO: 696240 - DNA, 25 bp, Rattus norvegicus
ttttaggaactggaaacactgaaat

SEQ ID NO: 696241 - DNA, 25 bp, Rattus norvegicus
ttttaggacctgaatacccacaaat

SEQ ID NO: 696242 - DNA, 25 bp, Rattus norvegicus
ttttaggacctgtatacccacaaat

SEQ ID NO: 696243 - DNA, 25 bp, Rattus norvegicus
ttttaggactgtccagcatcctgca

SEQ ID NO: 696244 - DNA, 25 bp, Rattus norvegicus
ttttaggactgtgcagcatcctgca

SEQ ID NO: 696245 - DNA, 25 bp, Rattus norvegicus
ttttaggagtttacgtggcagcttc

SEQ ID NO: 696246 - DNA, 25 bp, Rattus norvegicus
ttttaggagttttcgtggcagcttc

SEQ ID NO: 696247 - DNA, 25 bp, Rattus norvegicus
ttttaggccccgaaagtgtgtgtgg

SEQ ID NO: 696248 - DNA, 25 bp, Rattus norvegicus
ttttaggccccgtaagtgtgtgtgg

SEQ ID NO: 696249 - DNA, 25 bp, Rattus norvegicus
ttttaggctttgacctctgacttta

SEQ ID NO: 696250 - DNA, 25 bp, Rattus norvegicus
ttttaggctttgtcctctgacttta

SEQ ID NO: 696251 - DNA, 25 bp, Rattus norvegicus
ttttagggcttgatgcatgcacact

SEQ ID NO: 696252 - DNA, 25 bp, Rattus norvegicus
ttttagggcttgttgcatgcacact

SEQ ID NO: 696253 - DNA, 25 bp, Rattus norvegicus
ttttagggtttgaacttgctcgcct

SEQ ID NO: 696254 - DNA, 25 bp, Rattus norvegicus
ttttagggtttgtacttgctcgcct

SEQ ID NO: 696255 - DNA, 25 bp, Rattus norvegicus
ttttaggtgttgacttctgggccct

SEQ ID NO: 696256 - DNA, 25 bp, Rattus norvegicus
ttttaggtgttgtcttctgggccct

SEQ ID NO: 696257 - DNA, 25 bp, Rattus norvegicus
ttttaggttaccctgcagctgggca

SEQ ID NO: 696258 - DNA, 25 bp, Rattus norvegicus
ttttaggttaccgtgcagctgggca

SEQ ID NO: 696259 - DNA, 25 bp, Rattus norvegicus
ttttagtactaacctgccttggcag

SEQ ID NO: 696260 - DNA, 25 bp, Rattus norvegicus
ttttagtactaagctgccttggcag

SEQ ID NO: 696261 - DNA, 25 bp, Rattus norvegicus
ttttagtcaactatgcttgtcccat

SEQ ID NO: 696262 - DNA, 25 bp, Rattus norvegicus
ttttagtcaactttgcttgtcccat

SEQ ID NO: 696263 - DNA, 25 bp, Rattus norvegicus
ttttagtcagctaaagacccctgcc

SEQ ID NO: 696264 - DNA, 25 bp, Rattus norvegicus
ttttagtcagcttaagacccctgcc

SEQ ID NO: 696265 - DNA, 25 bp, Rattus norvegicus
ttttagtgacaccttttgcttgctc

SEQ ID NO: 696266 - DNA, 25 bp, Rattus norvegicus
ttttagtgacacgttttgcttgctc

SEQ ID NO: 696267 - DNA, 25 bp, Rattus norvegicus
ttttagtgcagcaccgtggttacaa

SEQ ID NO: 696268 - DNA, 25 bp, Rattus norvegicus
ttttagtgcagctccgtggttacaa

SEQ ID NO: 696269 - DNA, 25 bp, Rattus norvegicus
ttttagtgcattaccagctgggtct

SEQ ID NO: 696270 - DNA, 25 bp, Rattus norvegicus
ttttagtgcatttccagctgggtct

SEQ ID NO: 696271 - DNA, 25 bp, Rattus norvegicus
ttttagtgctcaaggccgtagacat

SEQ ID NO: 696272 - DNA, 25 bp, Rattus norvegicus
ttttagtgctcatggccgtagacat

SEQ ID NO: 696273 - DNA, 25 bp, Rattus norvegicus
ttttagtgctctcttttccatagtg

SEQ ID NO: 696274 - DNA, 25 bp, Rattus norvegicus
ttttagtgctctgttttccatagtg

SEQ ID NO: 696275 - DNA, 25 bp, Rattus norvegicus
ttttagtgtctgagtctcagtggcc

SEQ ID NO: 696276 - DNA, 25 bp, Rattus norvegicus
ttttagtgtctgtgtctcagtggcc

SEQ ID NO: 696277 - DNA, 25 bp, Rattus norvegicus
ttttagtgttgaagtgaaatgcccc

SEQ ID NO: 696278 - DNA, 25 bp, Rattus norvegicus
ttttagtgttgatgtgaaatgcccc

SEQ ID NO: 696279 - DNA, 25 bp, Rattus norvegicus
ttttagttatcccagctcagctgag

SEQ ID NO: 696280 - DNA, 25 bp, Rattus norvegicus
ttttagttatccgagctcagctgag

SEQ ID NO: 696281 - DNA, 25 bp, Rattus norvegicus
ttttagttcaatcccagcactttgt

SEQ ID NO: 696282 - DNA, 25 bp, Rattus norvegicus
ttttagttcaatgccagcactttgt

SEQ ID NO: 696283 - DNA, 25 bp, Rattus norvegicus
ttttataaaaagctggacctgaaca

SEQ ID NO: 696284 - DNA, 25 bp, Rattus norvegicus
ttttataaaaaggtggacctgaaca

SEQ ID NO: 696285 - DNA, 25 bp, Rattus norvegicus
ttttataaacctcgagtgtcctctg

SEQ ID NO: 696286 - DNA, 25 bp, Rattus norvegicus
ttttataaacctggagtgtcctctg

SEQ ID NO: 696287 - DNA, 25 bp, Rattus norvegicus
ttttataactccatagaggcgccag

SEQ ID NO: 696288 - DNA, 25 bp, Rattus norvegicus
ttttataactccttagaggcgccag

SEQ ID NO: 696289 - DNA, 25 bp, Rattus norvegicus
ttttataatgtaccctcactcttcc

SEQ ID NO: 696290 - DNA, 25 bp, Rattus norvegicus
ttttataatgtagcctcactcttcc

SEQ ID NO: 696291 - DNA, 25 bp, Rattus norvegicus
ttttataccagaacatgtccacccc

SEQ ID NO: 696292 - DNA, 25 bp, Rattus norvegicus
ttttataccagatcatgtccacccc

SEQ ID NO: 696293 - DNA, 25 bp, Rattus norvegicus
ttttatagagagaatcccacacctt

SEQ ID NO: 696294 - DNA, 25 bp, Rattus norvegicus
ttttatagagagtatcccacacctt

SEQ ID NO: 696295 - DNA, 25 bp, Rattus norvegicus
ttttatatactaacttccctgcctg

SEQ ID NO: 696296 - DNA, 25 bp, Rattus norvegicus
ttttatatactatcttccctgcctg

SEQ ID NO: 696297 - DNA, 25 bp, Rattus norvegicus
ttttatatagatctccccttcctgg

SEQ ID NO: 696298 - DNA, 25 bp, Rattus norvegicus
ttttatatagatgtccccttcctgg

SEQ ID NO: 696299 - DNA, 25 bp, Rattus norvegicus
ttttatatcaaaacatcaggcatgg

SEQ ID NO: 696300 - DNA, 25 bp, Rattus norvegicus
ttttatatcaaatcatcaggcatgg

SEQ ID NO: 696301 - DNA, 25 bp, Rattus norvegicus
ttttatatcacacatcgcgtacacg

SEQ ID NO: 696302 - DNA, 25 bp, Rattus norvegicus
ttttatatcacagatcgcgtacacg

SEQ ID NO: 696303 - DNA, 25 bp, Rattus norvegicus
ttttatatccagatccttttctggg

SEQ ID NO: 696304 - DNA, 25 bp, Rattus norvegicus
ttttatatccagttccttttctggg

SEQ ID NO: 696305 - DNA, 25 bp, Rattus norvegicus
ttttatatccctaccctgtgggaag

SEQ ID NO: 696306 - DNA, 25 bp, Rattus norvegicus
ttttatatcccttccctgtgggaag

SEQ ID NO: 696307 - DNA, 25 bp, Rattus norvegicus
ttttatatcgccactgatgtctggt

SEQ ID NO: 696308 - DNA, 25 bp, Rattus norvegicus
ttttatatcgcctctgatgtctggt

SEQ ID NO: 696309 - DNA, 25 bp, Rattus norvegicus
ttttatatcttcaggacactggagt

SEQ ID NO: 696310 - DNA, 25 bp, Rattus norvegicus
ttttatatcttctggacactggagt

SEQ ID NO: 696311 - DNA, 25 bp, Rattus norvegicus
ttttatatgccaaggtgagaccctc

SEQ ID NO: 696312 - DNA, 25 bp, Rattus norvegicus
ttttatatgccatggtgagaccctc

SEQ ID NO: 696313 - DNA, 25 bp, Rattus norvegicus
ttttatattttgacagtagcactga

SEQ ID NO: 696314 - DNA, 25 bp, Rattus norvegicus
ttttatattttgtcagtagcactga

SEQ ID NO: 696315 - DNA, 25 bp, Rattus norvegicus
ttttatcagcgcatggtggttttaa

SEQ ID NO: 696316 - DNA, 25 bp, Rattus norvegicus
ttttatcagcgcttggtggttttaa

SEQ ID NO: 696317 - DNA, 25 bp, Rattus norvegicus
ttttatcagggtactcctttctcac

SEQ ID NO: 696318 - DNA, 25 bp, Rattus norvegicus
ttttatcagggttctcctttctcac

SEQ ID NO: 696319 - DNA, 25 bp, Rattus norvegicus
ttttatcatgtaaggctgtttgcct

SEQ ID NO: 696320 - DNA, 25 bp, Rattus norvegicus
ttttatcatgtatggctgtttgcct

SEQ ID NO: 696321 - DNA, 25 bp, Rattus norvegicus
ttttatccacatacaacgcaccaga

SEQ ID NO: 696322 - DNA, 25 bp, Rattus norvegicus
ttttatccacattcaacgcaccaga

SEQ ID NO: 696323 - DNA, 25 bp, Rattus norvegicus
ttttatccagctatcaaatcttaga

SEQ ID NO: 696324 - DNA, 25 bp, Rattus norvegicus
ttttatccagctttcaaatcttaga

SEQ ID NO: 696325 - DNA, 25 bp, Rattus norvegicus
ttttatccaggacacatgatgctct

SEQ ID NO: 696326 - DNA, 25 bp, Rattus norvegicus
ttttatccaggagacatgatgctct

SEQ ID NO: 696327 - DNA, 25 bp, Rattus norvegicus
ttttatcccacactagatccggtac

SEQ ID NO: 696328 - DNA, 25 bp, Rattus norvegicus
ttttatcccacagtagatccggtac

SEQ ID NO: 696329 - DNA, 25 bp, Rattus norvegicus
ttttatcccctgaactcatagcaag

SEQ ID NO: 696330 - DNA, 25 bp, Rattus norvegicus
ttttatcccctgtactcatagcaag

SEQ ID NO: 696331 - DNA, 25 bp, Rattus norvegicus
ttttatccccttagctctgtagtac

SEQ ID NO: 696332 - DNA, 25 bp, Rattus norvegicus
ttttatcccctttgctctgtagtac

SEQ ID NO: 696333 - DNA, 25 bp, Rattus norvegicus
ttttatccgttgagctcacgtgtat

SEQ ID NO: 696334 - DNA, 25 bp, Rattus norvegicus
ttttatccgttgtgctcacgtgtat

SEQ ID NO: 696335 - DNA, 25 bp, Rattus norvegicus
ttttatcctcccagtgtcttcattt

SEQ ID NO: 696336 - DNA, 25 bp, Rattus norvegicus
ttttatcctccctgtgtcttcattt

SEQ ID NO: 696337 - DNA, 25 bp, Rattus norvegicus
ttttatcctctcaacagggcacttc

SEQ ID NO: 696338 - DNA, 25 bp, Rattus norvegicus
ttttatcctctctacagggcacttc

SEQ ID NO: 696339 - DNA, 25 bp, Rattus norvegicus
ttttatcggcgccagaagcaacttg

SEQ ID NO: 696340 - DNA, 25 bp, Rattus norvegicus
ttttatcggcgcgagaagcaacttg

SEQ ID NO: 696341 - DNA, 25 bp, Rattus norvegicus
ttttatcgtttcattcatccctcaa

SEQ ID NO: 696342 - DNA, 25 bp, Rattus norvegicus
ttttatcgtttctttcatccctcaa

SEQ ID NO: 696343 - DNA, 25 bp, Rattus norvegicus
ttttatctaagcaacgagtgtgggt

SEQ ID NO: 696344 - DNA, 25 bp, Rattus norvegicus
ttttatctaagctacgagtgtgggt

SEQ ID NO: 696345 - DNA, 25 bp, Rattus norvegicus
ttttatctagtccttatttttccag

SEQ ID NO: 696346 - DNA, 25 bp, Rattus norvegicus
ttttatctagtcgttatttttccag

SEQ ID NO: 696347 - DNA, 25 bp, Rattus norvegicus
ttttatctcatacacacccactgtt

SEQ ID NO: 696348 - DNA, 25 bp, Rattus norvegicus
ttttatctcatagacacccactgtt

SEQ ID NO: 696349 - DNA, 25 bp, Rattus norvegicus
ttttatctggatacctagctcgaac

SEQ ID NO: 696350 - DNA, 25 bp, Rattus norvegicus
ttttatctggattcctagctcgaac

SEQ ID NO: 696351 - DNA, 25 bp, Rattus norvegicus
ttttatctggtgcttctctgttttc

SEQ ID NO: 696352 - DNA, 25 bp, Rattus norvegicus
ttttatctggtggttctctgttttc

SEQ ID NO: 696353 - DNA, 25 bp, Rattus norvegicus
ttttatcttcagcagaggacgacga

SEQ ID NO: 696354 - DNA, 25 bp, Rattus norvegicus
ttttatcttcaggagaggacgacga

SEQ ID NO: 696355 - DNA, 25 bp, Rattus norvegicus
ttttatcttcctaggatccctttgg

SEQ ID NO: 696356 - DNA, 25 bp, Rattus norvegicus
ttttatcttccttggatccctttgg

SEQ ID NO: 696357 - DNA, 25 bp, Rattus norvegicus
ttttatctttgaaggcccagggcct

SEQ ID NO: 696358 - DNA, 25 bp, Rattus norvegicus
ttttatctttgatggcccagggcct

SEQ ID NO: 696359 - DNA, 25 bp, Rattus norvegicus
ttttatgaaacgcaccactatggat

SEQ ID NO: 696360 - DNA, 25 bp, Rattus norvegicus
ttttatgaaacggaccactatggat

SEQ ID NO: 696361 - DNA, 25 bp, Rattus norvegicus
ttttatgaagagagactgacgtggc

SEQ ID NO: 696362 - DNA, 25 bp, Rattus norvegicus
ttttatgaagagtgactgacgtggc

SEQ ID NO: 696363 - DNA, 25 bp, Rattus norvegicus
ttttatgaatgtactccaggatttg

SEQ ID NO: 696364 - DNA, 25 bp, Rattus norvegicus
ttttatgaatgttctccaggatttg

SEQ ID NO: 696365 - DNA, 25 bp, Rattus norvegicus
ttttatgaatttaatgccccttgtt

SEQ ID NO: 696366 - DNA, 25 bp, Rattus norvegicus
ttttatgaattttatgccccttgtt

SEQ ID NO: 696367 - DNA, 25 bp, Rattus norvegicus
ttttatgaccatcttctccaccttt

SEQ ID NO: 696368 - DNA, 25 bp, Rattus norvegicus
ttttatgaccatgttctccaccttt

SEQ ID NO: 696369 - DNA, 25 bp, Rattus norvegicus
ttttatgactctcctgggctcagga

SEQ ID NO: 696370 - DNA, 25 bp, Rattus norvegicus
ttttatgactctgctgggctcagga

SEQ ID NO: 696371 - DNA, 25 bp, Rattus norvegicus
ttttatgatgtcagaggcacaccct

SEQ ID NO: 696372 - DNA, 25 bp, Rattus norvegicus
ttttatgatgtctgaggcacaccct

SEQ ID NO: 696373 - DNA, 25 bp, Rattus norvegicus
ttttatgcaaacactaagctcctta

SEQ ID NO: 696374 - DNA, 25 bp, Rattus norvegicus
ttttatgcaaactctaagctcctta

SEQ ID NO: 696375 - DNA, 25 bp, Rattus norvegicus
ttttatgcatgtctcggcctgtgtg

SEQ ID NO: 696376 - DNA, 25 bp, Rattus norvegicus
ttttatgcatgtgtcggcctgtgtg

SEQ ID NO: 696377 - DNA, 25 bp, Rattus norvegicus
ttttatgccgccctggatcaaatct

SEQ ID NO: 696378 - DNA, 25 bp, Rattus norvegicus
ttttatgccgccgtggatcaaatct

SEQ ID NO: 696379 - DNA, 25 bp, Rattus norvegicus
ttttatgcctcaccctaaacgggcg

SEQ ID NO: 696380 - DNA, 25 bp, Rattus norvegicus
ttttatgcctcagcctaaacgggcg

SEQ ID NO: 696381 - DNA, 25 bp, Rattus norvegicus
ttttatgccttgaaccttgacggga

SEQ ID NO: 696382 - DNA, 25 bp, Rattus norvegicus
ttttatgccttgtaccttgacggga

SEQ ID NO: 696383 - DNA, 25 bp, Rattus norvegicus
ttttatgctactaagattgtgcttt

SEQ ID NO: 696384 - DNA, 25 bp, Rattus norvegicus
ttttatgctacttagattgtgcttt

SEQ ID NO: 696385 - DNA, 25 bp, Rattus norvegicus
ttttatgctatcactttcccagtaa

SEQ ID NO: 696386 - DNA, 25 bp, Rattus norvegicus
ttttatgctatctctttcccagtaa

SEQ ID NO: 696387 - DNA, 25 bp, Rattus norvegicus
ttttatggctgtacctaacactgga

SEQ ID NO: 696388 - DNA, 25 bp, Rattus norvegicus
ttttatggctgttcctaacactgga

SEQ ID NO: 696389 - DNA, 25 bp, Rattus norvegicus
ttttatgggaaacgcgtgtgctcag

SEQ ID NO: 696390 - DNA, 25 bp, Rattus norvegicus
ttttatgggaaaggcgtgtgctcag

SEQ ID NO: 696391 - DNA, 25 bp, Rattus norvegicus
ttttatgggataatcctggccttgc

SEQ ID NO: 696392 - DNA, 25 bp, Rattus norvegicus
ttttatgggatattcctggccttgc

SEQ ID NO: 696393 - DNA, 25 bp, Rattus norvegicus
ttttatggtgttaggcccggtagct

SEQ ID NO: 696394 - DNA, 25 bp, Rattus norvegicus
ttttatggtgtttggcccggtagct

SEQ ID NO: 696395 - DNA, 25 bp, Rattus norvegicus
ttttatgtaaacagccccgaggcca

SEQ ID NO: 696396 - DNA, 25 bp, Rattus norvegicus
ttttatgtaaactgccccgaggcca

SEQ ID NO: 696397 - DNA, 25 bp, Rattus norvegicus
ttttatgtaaccattatgtgagata

SEQ ID NO: 696398 - DNA, 25 bp, Rattus norvegicus
ttttatgtaacctttatgtgagata

SEQ ID NO: 696399 - DNA, 25 bp, Rattus norvegicus
ttttatgtacagctcaatagttagt

SEQ ID NO: 696400 - DNA, 25 bp, Rattus norvegicus
ttttatgtacaggtcaatagttagt

SEQ ID NO: 696401 - DNA, 25 bp, Rattus norvegicus
ttttatgtcaccctacagtctccaa

SEQ ID NO: 696402 - DNA, 25 bp, Rattus norvegicus
ttttatgtcaccgtacagtctccaa

SEQ ID NO: 696403 - DNA, 25 bp, Rattus norvegicus
ttttatgtcactatgttcaaggtat

SEQ ID NO: 696404 - DNA, 25 bp, Rattus norvegicus
ttttatgtcactttgttcaaggtat

SEQ ID NO: 696405 - DNA, 25 bp, Rattus norvegicus
ttttatgtccgtctgggtatccttg

SEQ ID NO: 696406 - DNA, 25 bp, Rattus norvegicus
ttttatgtccgtgtgggtatccttg

SEQ ID NO: 696407 - DNA, 25 bp, Rattus norvegicus
ttttatgtcctgagtctccgtcctg

SEQ ID NO: 696408 - DNA, 25 bp, Rattus norvegicus
ttttatgtcctgtgtctccgtcctg

SEQ ID NO: 696409 - DNA, 25 bp, Rattus norvegicus
ttttatgtgccaaaccccaaagtgc

SEQ ID NO: 696410 - DNA, 25 bp, Rattus norvegicus
ttttatgtgccataccccaaagtgc

SEQ ID NO: 696411 - DNA, 25 bp, Rattus norvegicus
ttttatgtgctgagaagtcttccca

SEQ ID NO: 696412 - DNA, 25 bp, Rattus norvegicus
ttttatgtgctgtgaagtcttccca

SEQ ID NO: 696413 - DNA, 25 bp, Rattus norvegicus
ttttatgttgggacattactcgaga

SEQ ID NO: 696414 - DNA, 25 bp, Rattus norvegicus
ttttatgttgggtcattactcgaga

SEQ ID NO: 696415 - DNA, 25 bp, Rattus norvegicus
ttttatgtttccaaatgatatgcca

SEQ ID NO: 696416 - DNA, 25 bp, Rattus norvegicus
ttttatgtttcctaatgatatgcca

SEQ ID NO: 696417 - DNA, 25 bp, Rattus norvegicus
ttttatgtttgcagcggaggagagc

SEQ ID NO: 696418 - DNA, 25 bp, Rattus norvegicus
ttttatgtttgctgcggaggagagc

SEQ ID NO: 696419 - DNA, 25 bp, Rattus norvegicus
ttttattaattcctcgctcattcca

SEQ ID NO: 696420 - DNA, 25 bp, Rattus norvegicus
ttttattaattcgtcgctcattcca

SEQ ID NO: 696421 - DNA, 25 bp, Rattus norvegicus
ttttattacctgaagtgctcaccgg

SEQ ID NO: 696422 - DNA, 25 bp, Rattus norvegicus
ttttattacctgtagtgctcaccgg

SEQ ID NO: 696423 - DNA, 25 bp, Rattus norvegicus
ttttattactcaacagaccctccat

SEQ ID NO: 696424 - DNA, 25 bp, Rattus norvegicus
ttttattactcatcagaccctccat

SEQ ID NO: 696425 - DNA, 25 bp, Rattus norvegicus
ttttattactgacactggccttcct

SEQ ID NO: 696426 - DNA, 25 bp, Rattus norvegicus
ttttattactgagactggccttcct

SEQ ID NO: 696427 - DNA, 25 bp, Rattus norvegicus
ttttattagtcaagccaggcaggga

SEQ ID NO: 696428 - DNA, 25 bp, Rattus norvegicus
ttttattagtcatgccaggcaggga

SEQ ID NO: 696429 - DNA, 25 bp, Rattus norvegicus
ttttattccagtcaaaacagatgtg

SEQ ID NO: 696430 - DNA, 25 bp, Rattus norvegicus
ttttattccagtgaaaacagatgtg

SEQ ID NO: 696431 - DNA, 25 bp, Rattus norvegicus
ttttattgacaaagccctgactgct

SEQ ID NO: 696432 - DNA, 25 bp, Rattus norvegicus
ttttattgacaatgccctgactgct

SEQ ID NO: 696433 - DNA, 25 bp, Rattus norvegicus
ttttattgagtgatgtacagtgtac

SEQ ID NO: 696434 - DNA, 25 bp, Rattus norvegicus
ttttattgagtgttgtacagtgtac

SEQ ID NO: 696435 - DNA, 25 bp, Rattus norvegicus
ttttattgataacccctaagtcctg

SEQ ID NO: 696436 - DNA, 25 bp, Rattus norvegicus
ttttattgataagccctaagtcctg

SEQ ID NO: 696437 - DNA, 25 bp, Rattus norvegicus
ttttattgcatgatacagtaccagt

SEQ ID NO: 696438 - DNA, 25 bp, Rattus norvegicus
ttttattgcatgttacagtaccagt

SEQ ID NO: 696439 - DNA, 25 bp, Rattus norvegicus
ttttattgccttatgagatttttca

SEQ ID NO: 696440 - DNA, 25 bp, Rattus norvegicus
ttttattgccttttgagatttttca

SEQ ID NO: 696441 - DNA, 25 bp, Rattus norvegicus
ttttattggtttcggcaacctcaca

SEQ ID NO: 696442 - DNA, 25 bp, Rattus norvegicus
ttttattggtttgggcaacctcaca

SEQ ID NO: 696443 - DNA, 25 bp, Rattus norvegicus
ttttattgtctaaccgggcgatttc

SEQ ID NO: 696444 - DNA, 25 bp, Rattus norvegicus
ttttattgtctatccgggcgatttc

SEQ ID NO: 696445 - DNA, 25 bp, Rattus norvegicus
ttttatttagtaatcctcctcctgc

SEQ ID NO: 696446 - DNA, 25 bp, Rattus norvegicus
ttttatttagtattcctcctcctgc

SEQ ID NO: 696447 - DNA, 25 bp, Rattus norvegicus
ttttatttatgtacacctccagaaa

SEQ ID NO: 696448 - DNA, 25 bp, Rattus norvegicus
ttttatttatgttcacctccagaaa

SEQ ID NO: 696449 - DNA, 25 bp, Rattus norvegicus
ttttatttattacagccccaagagc

SEQ ID NO: 696450 - DNA, 25 bp, Rattus norvegicus
ttttatttattagagccccaagagc

SEQ ID NO: 696451 - DNA, 25 bp, Rattus norvegicus
ttttatttccaaccgtgcatgctac

SEQ ID NO: 696452 - DNA, 25 bp, Rattus norvegicus
ttttatttccaagcgtgcatgctac

SEQ ID NO: 696453 - DNA, 25 bp, Rattus norvegicus
ttttatttctatactctaaccgata

SEQ ID NO: 696454 - DNA, 25 bp, Rattus norvegicus
ttttatttctattctctaaccgata

SEQ ID NO: 696455 - DNA, 25 bp, Rattus norvegicus
ttttatttgagccagtattccttgc

SEQ ID NO: 696456 - DNA, 25 bp, Rattus norvegicus
ttttatttgagcgagtattccttgc

SEQ ID NO: 696457 - DNA, 25 bp, Rattus norvegicus
ttttatttgctccttagctgctcta

SEQ ID NO: 696458 - DNA, 25 bp, Rattus norvegicus
ttttatttgctcgttagctgctcta

SEQ ID NO: 696459 - DNA, 25 bp, Rattus norvegicus
ttttatttggtgaggaggatttctc

SEQ ID NO: 696460 - DNA, 25 bp, Rattus norvegicus
ttttatttggtgtggaggatttctc

SEQ ID NO: 696461 - DNA, 25 bp, Rattus norvegicus
ttttattttttgacattgctctgtt

SEQ ID NO: 696462 - DNA, 25 bp, Rattus norvegicus
ttttattttttgtcattgctctgtt

SEQ ID NO: 696463 - DNA, 25 bp, Rattus norvegicus
ttttcaaaccaacctgtttcccctg

SEQ ID NO: 696464 - DNA, 25 bp, Rattus norvegicus
ttttcaaaccaagctgtttcccctg

SEQ ID NO: 696465 - DNA, 25 bp, Rattus norvegicus
ttttcaaactgtccttctgtgcgat

SEQ ID NO: 696466 - DNA, 25 bp, Rattus norvegicus
ttttcaaactgtgcttctgtgcgat

SEQ ID NO: 696467 - DNA, 25 bp, Rattus norvegicus
ttttcaaataatccagcctcgcctc

SEQ ID NO: 696468 - DNA, 25 bp, Rattus norvegicus
ttttcaaataatgcagcctcgcctc

SEQ ID NO: 696469 - DNA, 25 bp, Rattus norvegicus
ttttcaacaattcgcacacatggtt

SEQ ID NO: 696470 - DNA, 25 bp, Rattus norvegicus
ttttcaacaattggcacacatggtt

SEQ ID NO: 696471 - DNA, 25 bp, Rattus norvegicus
ttttcaacatcaaaaacctttttgt

SEQ ID NO: 696472 - DNA, 25 bp, Rattus norvegicus
ttttcaacatcataaacctttttgt

SEQ ID NO: 696473 - DNA, 25 bp, Rattus norvegicus
ttttcaactgtcagccttaagtaga

SEQ ID NO: 696474 - DNA, 25 bp, Rattus norvegicus
ttttcaactgtctgccttaagtaga

SEQ ID NO: 696475 - DNA, 25 bp, Rattus norvegicus
ttttcaagtcatcgtgcactgcatt

SEQ ID NO: 696476 - DNA, 25 bp, Rattus norvegicus
ttttcaagtcatggtgcactgcatt

SEQ ID NO: 696477 - DNA, 25 bp, Rattus norvegicus
ttttcaatagccactaaccttgcct

SEQ ID NO: 696478 - DNA, 25 bp, Rattus norvegicus
ttttcaatagcctctaaccttgcct

SEQ ID NO: 696479 - DNA, 25 bp, Rattus norvegicus
ttttcaatagtgacgtagcctttgt

SEQ ID NO: 696480 - DNA, 25 bp, Rattus norvegicus
ttttcaatagtgtcgtagcctttgt

SEQ ID NO: 696481 - DNA, 25 bp, Rattus norvegicus
ttttcaattggtatccccttcatct

SEQ ID NO: 696482 - DNA, 25 bp, Rattus norvegicus
ttttcaattggtttccccttcatct

SEQ ID NO: 696483 - DNA, 25 bp, Rattus norvegicus
ttttcacaaccacttttccatggca

SEQ ID NO: 696484 - DNA, 25 bp, Rattus norvegicus
ttttcacaaccagttttccatggca

SEQ ID NO: 696485 - DNA, 25 bp, Rattus norvegicus
ttttcacaatatcctcattatccag

SEQ ID NO: 696486 - DNA, 25 bp, Rattus norvegicus
ttttcacaatatgctcattatccag

SEQ ID NO: 696487 - DNA, 25 bp, Rattus norvegicus
ttttcacacaggctttcactgtata

SEQ ID NO: 696488 - DNA, 25 bp, Rattus norvegicus
ttttcacacagggtttcactgtata

SEQ ID NO: 696489 - DNA, 25 bp, Rattus norvegicus
ttttcacacctccaacttttctttg

SEQ ID NO: 696490 - DNA, 25 bp, Rattus norvegicus
ttttcacacctcgaacttttctttg

SEQ ID NO: 696491 - DNA, 25 bp, Rattus norvegicus
ttttcacacgtgctgctttattgcg

SEQ ID NO: 696492 - DNA, 25 bp, Rattus norvegicus
ttttcacacgtggtgctttattgcg

SEQ ID NO: 696493 - DNA, 25 bp, Rattus norvegicus
ttttcacagctaaaagtctcttgta

SEQ ID NO: 696494 - DNA, 25 bp, Rattus norvegicus
ttttcacagctataagtctcttgta

SEQ ID NO: 696495 - DNA, 25 bp, Rattus norvegicus
ttttcacaggctacttctcggtata

SEQ ID NO: 696496 - DNA, 25 bp, Rattus norvegicus
ttttcacaggcttcttctcggtata

SEQ ID NO: 696497 - DNA, 25 bp, Rattus norvegicus
ttttcacaggtgatattgttgcagt

SEQ ID NO: 696498 - DNA, 25 bp, Rattus norvegicus
ttttcacaggtgttattgttgcagt

SEQ ID NO: 696499 - DNA, 25 bp, Rattus norvegicus
ttttcacagtggacatgggcagggc

SEQ ID NO: 696500 - DNA, 25 bp, Rattus norvegicus
ttttcacagtggtcatgggcagggc

SEQ ID NO: 696501 - DNA, 25 bp, Rattus norvegicus
ttttcacatctcaccaatcctgctt

SEQ ID NO: 696502 - DNA, 25 bp, Rattus norvegicus
ttttcacatctctccaatcctgctt

SEQ ID NO: 696503 - DNA, 25 bp, Rattus norvegicus
ttttcaccaagccttcaatatccag

SEQ ID NO: 696504 - DNA, 25 bp, Rattus norvegicus
ttttcaccaagcgttcaatatccag

SEQ ID NO: 696505 - DNA, 25 bp, Rattus norvegicus
ttttcaccacacaagatagctccgg

SEQ ID NO: 696506 - DNA, 25 bp, Rattus norvegicus
ttttcaccacactagatagctccgg

SEQ ID NO: 696507 - DNA, 25 bp, Rattus norvegicus
ttttcaccacctctgcatgtcctta

SEQ ID NO: 696508 - DNA, 25 bp, Rattus norvegicus
ttttcaccacctgtgcatgtcctta

SEQ ID NO: 696509 - DNA, 25 bp, Rattus norvegicus
ttttcaccaggcaggtggttcatcc

SEQ ID NO: 696510 - DNA, 25 bp, Rattus norvegicus
ttttcaccaggctggtggttcatcc

SEQ ID NO: 696511 - DNA, 25 bp, Rattus norvegicus
ttttcaccatttctgcccaggaaga

SEQ ID NO: 696512 - DNA, 25 bp, Rattus norvegicus
ttttcaccatttgtgcccaggaaga

SEQ ID NO: 696513 - DNA, 25 bp, Rattus norvegicus
ttttcacccatgctgttgattgcta

SEQ ID NO: 696514 - DNA, 25 bp, Rattus norvegicus
ttttcacccatggtgttgattgcta

SEQ ID NO: 696515 - DNA, 25 bp, Rattus norvegicus
ttttcacccttcagcggacgggcag

SEQ ID NO: 696516 - DNA, 25 bp, Rattus norvegicus
ttttcacccttctgcggacgggcag

SEQ ID NO: 696517 - DNA, 25 bp, Rattus norvegicus
ttttcacctaaaaccacccataaat

SEQ ID NO: 696518 - DNA, 25 bp, Rattus norvegicus
ttttcacctaaatccacccataaat

SEQ ID NO: 696519 - DNA, 25 bp, Rattus norvegicus
ttttcaccttgcagcccagtagaaa

SEQ ID NO: 696520 - DNA, 25 bp, Rattus norvegicus
ttttcaccttgctgcccagtagaaa

SEQ ID NO: 696521 - DNA, 25 bp, Rattus norvegicus
ttttcacgcaatcacacattctagg

SEQ ID NO: 696522 - DNA, 25 bp, Rattus norvegicus
ttttcacgcaatgacacattctagg

SEQ ID NO: 696523 - DNA, 25 bp, Rattus norvegicus
ttttcacggttcaacaccctgttgg

SEQ ID NO: 696524 - DNA, 25 bp, Rattus norvegicus
ttttcacggttctacaccctgttgg

SEQ ID NO: 696525 - DNA, 25 bp, Rattus norvegicus
ttttcacgtgggacctgggatcaca

SEQ ID NO: 696526 - DNA, 25 bp, Rattus norvegicus
ttttcacgtgggtcctgggatcaca

SEQ ID NO: 696527 - DNA, 25 bp, Rattus norvegicus
ttttcactcaacagtgccatgccta

SEQ ID NO: 696528 - DNA, 25 bp, Rattus norvegicus
ttttcactcaactgtgccatgccta

SEQ ID NO: 696529 - DNA, 25 bp, Rattus norvegicus
ttttcactcaggctgcactgggtgc

SEQ ID NO: 696530 - DNA, 25 bp, Rattus norvegicus
ttttcactcagggtgcactgggtgc

SEQ ID NO: 696531 - DNA, 25 bp, Rattus norvegicus
ttttcactcttgaatgggacctgag

SEQ ID NO: 696532 - DNA, 25 bp, Rattus norvegicus
ttttcactcttgtatgggacctgag

SEQ ID NO: 696533 - DNA, 25 bp, Rattus norvegicus
ttttcactgagtacttgctctgggc

SEQ ID NO: 696534 - DNA, 25 bp, Rattus norvegicus
ttttcactgagttcttgctctgggc

SEQ ID NO: 696535 - DNA, 25 bp, Rattus norvegicus
ttttcactgatacgtcttttcccag

SEQ ID NO: 696536 - DNA, 25 bp, Rattus norvegicus
ttttcactgataggtcttttcccag

SEQ ID NO: 696537 - DNA, 25 bp, Rattus norvegicus
ttttcactggacaaaacagcctccc

SEQ ID NO: 696538 - DNA, 25 bp, Rattus norvegicus
ttttcactggactaaacagcctccc

SEQ ID NO: 696539 - DNA, 25 bp, Rattus norvegicus
ttttcactgtccagccaaacaagca

SEQ ID NO: 696540 - DNA, 25 bp, Rattus norvegicus
ttttcactgtcctgccaaacaagca

SEQ ID NO: 696541 - DNA, 25 bp, Rattus norvegicus
ttttcacttactatggaagggtgca

SEQ ID NO: 696542 - DNA, 25 bp, Rattus norvegicus
ttttcacttactttggaagggtgca

SEQ ID NO: 696543 - DNA, 25 bp, Rattus norvegicus
ttttcacttgaaatacaggacccat

SEQ ID NO: 696544 - DNA, 25 bp, Rattus norvegicus
ttttcacttgaattacaggacccat

SEQ ID NO: 696545 - DNA, 25 bp, Rattus norvegicus
ttttcagacaggctgggttcgaact

SEQ ID NO: 696546 - DNA, 25 bp, Rattus norvegicus
ttttcagacagggtgggttcgaact

SEQ ID NO: 696547 - DNA, 25 bp, Rattus norvegicus
ttttcagaccacatgacctttagcc

SEQ ID NO: 696548 - DNA, 25 bp, Rattus norvegicus
ttttcagaccacttgacctttagcc

SEQ ID NO: 696549 - DNA, 25 bp, Rattus norvegicus
ttttcagactgcctttctttttgta

SEQ ID NO: 696550 - DNA, 25 bp, Rattus norvegicus
ttttcagactgcgtttctttttgta

SEQ ID NO: 696551 - DNA, 25 bp, Rattus norvegicus
ttttcagacttcaggaggccttagg

SEQ ID NO: 696552 - DNA, 25 bp, Rattus norvegicus
ttttcagacttctggaggccttagg

SEQ ID NO: 696553 - DNA, 25 bp, Rattus norvegicus
ttttcagagttccttcagcccgtga

SEQ ID NO: 696554 - DNA, 25 bp, Rattus norvegicus
ttttcagagttcgttcagcccgtga

SEQ ID NO: 696555 - DNA, 25 bp, Rattus norvegicus
ttttcagcaatacggccttgcctaa

SEQ ID NO: 696556 - DNA, 25 bp, Rattus norvegicus
ttttcagcaatagggccttgcctaa

SEQ ID NO: 696557 - DNA, 25 bp, Rattus norvegicus
ttttcagcacttaggaaccccttct

SEQ ID NO: 696558 - DNA, 25 bp, Rattus norvegicus
ttttcagcactttggaaccccttct

SEQ ID NO: 696559 - DNA, 25 bp, Rattus norvegicus
ttttcagcagaaacgtgtgatacat

SEQ ID NO: 696560 - DNA, 25 bp, Rattus norvegicus
ttttcagcagaatcgtgtgatacat

SEQ ID NO: 696561 - DNA, 25 bp, Rattus norvegicus
ttttcagcagcccttccaagatgaa

SEQ ID NO: 696562 - DNA, 25 bp, Rattus norvegicus
ttttcagcagccgttccaagatgaa

SEQ ID NO: 696563 - DNA, 25 bp, Rattus norvegicus
ttttcagcagttctgttgcccttga

SEQ ID NO: 696564 - DNA, 25 bp, Rattus norvegicus
ttttcagcagttgtgttgcccttga

SEQ ID NO: 696565 - DNA, 25 bp, Rattus norvegicus
ttttcagccaatccctgatgtggat

SEQ ID NO: 696566 - DNA, 25 bp, Rattus norvegicus
ttttcagccaatgcctgatgtggat

SEQ ID NO: 696567 - DNA, 25 bp, Rattus norvegicus
ttttcagcccacactggcaaatgtg

SEQ ID NO: 696568 - DNA, 25 bp, Rattus norvegicus
ttttcagcccactctggcaaatgtg

SEQ ID NO: 696569 - DNA, 25 bp, Rattus norvegicus
ttttcagcccttccttggatgagag

SEQ ID NO: 696570 - DNA, 25 bp, Rattus norvegicus
ttttcagcccttgcttggatgagag

SEQ ID NO: 696571 - DNA, 25 bp, Rattus norvegicus
ttttcagccgcgagttagttagtct

SEQ ID NO: 696572 - DNA, 25 bp, Rattus norvegicus
ttttcagccgcgtgttagttagtct

SEQ ID NO: 696573 - DNA, 25 bp, Rattus norvegicus
ttttcagcctagacagcccagcacg

SEQ ID NO: 696574 - DNA, 25 bp, Rattus norvegicus
ttttcagcctagtcagcccagcacg

SEQ ID NO: 696575 - DNA, 25 bp, Rattus norvegicus
ttttcagctaagctcaccccagtga

SEQ ID NO: 696576 - DNA, 25 bp, Rattus norvegicus
ttttcagctaaggtcaccccagtga

SEQ ID NO: 696577 - DNA, 25 bp, Rattus norvegicus
ttttcagctgaaatctcctactctc

SEQ ID NO: 696578 - DNA, 25 bp, Rattus norvegicus
ttttcagctgaattctcctactctc

SEQ ID NO: 696579 - DNA, 25 bp, Rattus norvegicus
ttttcagcttcacatcagggtgcag

SEQ ID NO: 696580 - DNA, 25 bp, Rattus norvegicus
ttttcagcttcagatcagggtgcag

SEQ ID NO: 696581 - DNA, 25 bp, Rattus norvegicus
ttttcaggaagtcaatctggctggt

SEQ ID NO: 696582 - DNA, 25 bp, Rattus norvegicus
ttttcaggaagtgaatctggctggt

SEQ ID NO: 696583 - DNA, 25 bp, Rattus norvegicus
ttttcaggacctcccagagatgagt

SEQ ID NO: 696584 - DNA, 25 bp, Rattus norvegicus
ttttcaggacctgccagagatgagt

SEQ ID NO: 696585 - DNA, 25 bp, Rattus norvegicus
ttttcaggatgtcggcaggacttca

SEQ ID NO: 696586 - DNA, 25 bp, Rattus norvegicus
ttttcaggatgtgggcaggacttca

SEQ ID NO: 696587 - DNA, 25 bp, Rattus norvegicus
ttttcaggccatcttaccttaccac

SEQ ID NO: 696588 - DNA, 25 bp, Rattus norvegicus
ttttcaggccatgttaccttaccac

SEQ ID NO: 696589 - DNA, 25 bp, Rattus norvegicus
ttttcaggcgatcagggtttcacat

SEQ ID NO: 696590 - DNA, 25 bp, Rattus norvegicus
ttttcaggcgatgagggtttcacat

SEQ ID NO: 696591 - DNA, 25 bp, Rattus norvegicus
ttttcagggcaccaaagctgcgtgt

SEQ ID NO: 696592 - DNA, 25 bp, Rattus norvegicus
ttttcagggcacgaaagctgcgtgt

SEQ ID NO: 696593 - DNA, 25 bp, Rattus norvegicus
ttttcaggttcaaccttgagccacc

SEQ ID NO: 696594 - DNA, 25 bp, Rattus norvegicus
ttttcaggttcatccttgagccacc

SEQ ID NO: 696595 - DNA, 25 bp, Rattus norvegicus
ttttcaggttttagagccgagccga

SEQ ID NO: 696596 - DNA, 25 bp, Rattus norvegicus
ttttcaggtttttgagccgagccga

SEQ ID NO: 696597 - DNA, 25 bp, Rattus norvegicus
ttttcagtagtgatcttgggcccaa

SEQ ID NO: 696598 - DNA, 25 bp, Rattus norvegicus
ttttcagtagtgttcttgggcccaa

SEQ ID NO: 696599 - DNA, 25 bp, Rattus norvegicus
ttttcagtatatacaattgccaaag

SEQ ID NO: 696600 - DNA, 25 bp, Rattus norvegicus
ttttcagtatattcaattgccaaag

SEQ ID NO: 696601 - DNA, 25 bp, Rattus norvegicus
ttttcagtcagcctgctctatcagg

SEQ ID NO: 696602 - DNA, 25 bp, Rattus norvegicus
ttttcagtcagcgtgctctatcagg

SEQ ID NO: 696603 - DNA, 25 bp, Rattus norvegicus
ttttcagtgagccaccttggtgtat

SEQ ID NO: 696604 - DNA, 25 bp, Rattus norvegicus
ttttcagtgagcgaccttggtgtat

SEQ ID NO: 696605 - DNA, 25 bp, Rattus norvegicus
ttttcagtgcacacatgctttgaga

SEQ ID NO: 696606 - DNA, 25 bp, Rattus norvegicus
ttttcagtgcactcatgctttgaga

SEQ ID NO: 696607 - DNA, 25 bp, Rattus norvegicus
ttttcagtgccaacgtagttgacat

SEQ ID NO: 696608 - DNA, 25 bp, Rattus norvegicus
ttttcagtgccaagaatccccaagg

SEQ ID NO: 696609 - DNA, 25 bp, Rattus norvegicus
ttttcagtgccatcgtagttgacat

SEQ ID NO: 696610 - DNA, 25 bp, Rattus norvegicus
ttttcagtgccatgaatccccaagg

SEQ ID NO: 696611 - DNA, 25 bp, Rattus norvegicus
ttttcagtgtcgagaacctcaggcc

SEQ ID NO: 696612 - DNA, 25 bp, Rattus norvegicus
ttttcagtgtcgtgaacctcaggcc

SEQ ID NO: 696613 - DNA, 25 bp, Rattus norvegicus
ttttcagtgtgaaatcgcagccctt

SEQ ID NO: 696614 - DNA, 25 bp, Rattus norvegicus
ttttcagtgtgatatcgcagccctt

SEQ ID NO: 696615 - DNA, 25 bp, Rattus norvegicus
ttttcagtttcacggccaggtaatt

SEQ ID NO: 696616 - DNA, 25 bp, Rattus norvegicus
ttttcagtttcagggccaggtaatt

SEQ ID NO: 696617 - DNA, 25 bp, Rattus norvegicus
ttttcataccccaccaagctggctg

SEQ ID NO: 696618 - DNA, 25 bp, Rattus norvegicus
ttttcatacccctccaagctggctg

SEQ ID NO: 696619 - DNA, 25 bp, Rattus norvegicus
ttttcatacttacaaccgtcccatc

SEQ ID NO: 696620 - DNA, 25 bp, Rattus norvegicus
ttttcatacttagaaccgtcccatc

SEQ ID NO: 696621 - DNA, 25 bp, Rattus norvegicus
ttttcatagctcagactgtcatgga

SEQ ID NO: 696622 - DNA, 25 bp, Rattus norvegicus
ttttcatagctctgactgtcatgga

SEQ ID NO: 696623 - DNA, 25 bp, Rattus norvegicus
ttttcatatattatgctacctaagt

SEQ ID NO: 696624 - DNA, 25 bp, Rattus norvegicus
ttttcatatattttgctacctaagt

SEQ ID NO: 696625 - DNA, 25 bp, Rattus norvegicus
ttttcatattacatctcaccacctt

SEQ ID NO: 696626 - DNA, 25 bp, Rattus norvegicus
ttttcatattacttctcaccacctt

SEQ ID NO: 696627 - DNA, 25 bp, Rattus norvegicus
ttttcatcagataccagggccagga

SEQ ID NO: 696628 - DNA, 25 bp, Rattus norvegicus
ttttcatcagattccagggccagga

SEQ ID NO: 696629 - DNA, 25 bp, Rattus norvegicus
ttttcatccagacccctgactagtg

SEQ ID NO: 696630 - DNA, 25 bp, Rattus norvegicus
ttttcatccagagccctgactagtg

SEQ ID NO: 696631 - DNA, 25 bp, Rattus norvegicus
ttttcatccagcaaagtgccagcca

SEQ ID NO: 696632 - DNA, 25 bp, Rattus norvegicus
ttttcatccagctaagtgccagcca

SEQ ID NO: 696633 - DNA, 25 bp, Rattus norvegicus
ttttcatccgtcattatctggcgga

SEQ ID NO: 696634 - DNA, 25 bp, Rattus norvegicus
ttttcatccgtctttatctggcgga

SEQ ID NO: 696635 - DNA, 25 bp, Rattus norvegicus
ttttcatcctgaaaggtggtccaaa

SEQ ID NO: 696636 - DNA, 25 bp, Rattus norvegicus
ttttcatcctgataggtggtccaaa

SEQ ID NO: 696637 - DNA, 25 bp, Rattus norvegicus
ttttcatcgtgcctcagtctttaga

SEQ ID NO: 696638 - DNA, 25 bp, Rattus norvegicus
ttttcatcgtgcgtcagtctttaga

SEQ ID NO: 696639 - DNA, 25 bp, Rattus norvegicus
ttttcatcttctctttctcccctaa

SEQ ID NO: 696640 - DNA, 25 bp, Rattus norvegicus
ttttcatcttctgtttctcccctaa

SEQ ID NO: 696641 - DNA, 25 bp, Rattus norvegicus
ttttcatcttggcatcatgctacaa

SEQ ID NO: 696642 - DNA, 25 bp, Rattus norvegicus
ttttcatcttgggatcatgctacaa

SEQ ID NO: 696643 - DNA, 25 bp, Rattus norvegicus
ttttcatctttcctatgaagccaga

SEQ ID NO: 696644 - DNA, 25 bp, Rattus norvegicus
ttttcatctttcgtatgaagccaga

SEQ ID NO: 696645 - DNA, 25 bp, Rattus norvegicus
ttttcatgaagacaagttgggccca

SEQ ID NO: 696646 - DNA, 25 bp, Rattus norvegicus
ttttcatgaagagaagttgggccca

SEQ ID NO: 696647 - DNA, 25 bp, Rattus norvegicus
ttttcatgagtgactgcctcaccag

SEQ ID NO: 696648 - DNA, 25 bp, Rattus norvegicus
ttttcatgagtgtctgcctcaccag

SEQ ID NO: 696649 - DNA, 25 bp, Rattus norvegicus
ttttcatgccatattccaagagaga

SEQ ID NO: 696650 - DNA, 25 bp, Rattus norvegicus
ttttcatgccattttccaagagaga

SEQ ID NO: 696651 - DNA, 25 bp, Rattus norvegicus
ttttcatgctcccaaggagaacccc

SEQ ID NO: 696652 - DNA, 25 bp, Rattus norvegicus
ttttcatgctccgaaggagaacccc

SEQ ID NO: 696653 - DNA, 25 bp, Rattus norvegicus
ttttcatggaagattcaccctctcg

SEQ ID NO: 696654 - DNA, 25 bp, Rattus norvegicus
ttttcatggaagtttcaccctctcg

SEQ ID NO: 696655 - DNA, 25 bp, Rattus norvegicus
ttttcatggatcactgtttcacaag

SEQ ID NO: 696656 - DNA, 25 bp, Rattus norvegicus
ttttcatggatctctgtttcacaag

SEQ ID NO: 696657 - DNA, 25 bp, Rattus norvegicus
ttttcatggcttatcctgtttccca

SEQ ID NO: 696658 - DNA, 25 bp, Rattus norvegicus
ttttcatggcttttcctgtttccca

SEQ ID NO: 696659 - DNA, 25 bp, Rattus norvegicus
ttttcatgtacaactcaactccgct

SEQ ID NO: 696660 - DNA, 25 bp, Rattus norvegicus
ttttcatgtacatctcaactccgct

SEQ ID NO: 696661 - DNA, 25 bp, Rattus norvegicus
ttttcatgtagtataggatcctcat

SEQ ID NO: 696662 - DNA, 25 bp, Rattus norvegicus
ttttcatgtagtttaggatcctcat

SEQ ID NO: 696663 - DNA, 25 bp, Rattus norvegicus
ttttcatgtcacagagtctcctgag

SEQ ID NO: 696664 - DNA, 25 bp, Rattus norvegicus
ttttcatgtcactgagtctcctgag

SEQ ID NO: 696665 - DNA, 25 bp, Rattus norvegicus
ttttcatgtctaatcacctatcctg

SEQ ID NO: 696666 - DNA, 25 bp, Rattus norvegicus
ttttcatgtctattcacctatcctg

SEQ ID NO: 696667 - DNA, 25 bp, Rattus norvegicus
ttttcatgtggcattgtctaggtta

SEQ ID NO: 696668 - DNA, 25 bp, Rattus norvegicus
ttttcatgtggctttgtctaggtta

SEQ ID NO: 696669 - DNA, 25 bp, Rattus norvegicus
ttttcatgtgttacggcttctgcca

SEQ ID NO: 696670 - DNA, 25 bp, Rattus norvegicus
ttttcatgtgtttcggcttctgcca

SEQ ID NO: 696671 - DNA, 25 bp, Rattus norvegicus
ttttcattcactctcttgcctttat

SEQ ID NO: 696672 - DNA, 25 bp, Rattus norvegicus
ttttcattcactgtcttgcctttat

SEQ ID NO: 696673 - DNA, 25 bp, Rattus norvegicus
ttttcattcataaatccgagcccgc

SEQ ID NO: 696674 - DNA, 25 bp, Rattus norvegicus
ttttcattcatatatccgagcccgc

SEQ ID NO: 696675 - DNA, 25 bp, Rattus norvegicus
ttttcattcattctgttttccccct

SEQ ID NO: 696676 - DNA, 25 bp, Rattus norvegicus
ttttcattcattgtgttttccccct

SEQ ID NO: 696677 - DNA, 25 bp, Rattus norvegicus
ttttcattccatatacctcaatctc

SEQ ID NO: 696678 - DNA, 25 bp, Rattus norvegicus
ttttcattccatttacctcaatctc

SEQ ID NO: 696679 - DNA, 25 bp, Rattus norvegicus
ttttcattccctagctctttgtagt

SEQ ID NO: 696680 - DNA, 25 bp, Rattus norvegicus
ttttcattcccttgctctttgtagt

SEQ ID NO: 696681 - DNA, 25 bp, Rattus norvegicus
ttttcattccttattccgcatttac

SEQ ID NO: 696682 - DNA, 25 bp, Rattus norvegicus
ttttcattccttccagtgttgtaca

SEQ ID NO: 696683 - DNA, 25 bp, Rattus norvegicus
ttttcattccttgcagtgttgtaca

SEQ ID NO: 696684 - DNA, 25 bp, Rattus norvegicus
ttttcattcctttttccgcatttac

SEQ ID NO: 696685 - DNA, 25 bp, Rattus norvegicus
ttttcattcttaagcaactctcaaa

SEQ ID NO: 696686 - DNA, 25 bp, Rattus norvegicus
ttttcattcttatgcaactctcaaa

SEQ ID NO: 696687 - DNA, 25 bp, Rattus norvegicus
ttttcatttcttcccgatgttcgat

SEQ ID NO: 696688 - DNA, 25 bp, Rattus norvegicus
ttttcatttcttgccgatgttcgat

SEQ ID NO: 696689 - DNA, 25 bp, Rattus norvegicus
ttttcatttgccattgttctccagt

SEQ ID NO: 696690 - DNA, 25 bp, Rattus norvegicus
ttttcatttgcctttgttctccagt

SEQ ID NO: 696691 - DNA, 25 bp, Rattus norvegicus
ttttcatttgtcagactgccgccat

SEQ ID NO: 696692 - DNA, 25 bp, Rattus norvegicus
ttttcatttgtctgactgccgccat

SEQ ID NO: 696693 - DNA, 25 bp, Rattus norvegicus
ttttccaaaaataatcctgtgctta

SEQ ID NO: 696694 - DNA, 25 bp, Rattus norvegicus
ttttccaaaaattatcctgtgctta

SEQ ID NO: 696695 - DNA, 25 bp, Rattus norvegicus
ttttccaaagcacgccacaggcttc

SEQ ID NO: 696696 - DNA, 25 bp, Rattus norvegicus
ttttccaaagcaggccacaggcttc

SEQ ID NO: 696697 - DNA, 25 bp, Rattus norvegicus
ttttccaaaggaccggtcaggccct

SEQ ID NO: 696698 - DNA, 25 bp, Rattus norvegicus
ttttccaaaggagcggtcaggccct

SEQ ID NO: 696699 - DNA, 25 bp, Rattus norvegicus
ttttccaacagcataacttctccta

SEQ ID NO: 696700 - DNA, 25 bp, Rattus norvegicus
ttttccaacagcttaacttctccta

SEQ ID NO: 696701 - DNA, 25 bp, Rattus norvegicus
ttttccaactcacgcatcttttcaa

SEQ ID NO: 696702 - DNA, 25 bp, Rattus norvegicus
ttttccaactcaggcatcttttcaa

SEQ ID NO: 696703 - DNA, 25 bp, Rattus norvegicus
ttttccaatgttctctgataggcag

SEQ ID NO: 696704 - DNA, 25 bp, Rattus norvegicus
ttttccaatgttgtctgataggcag

SEQ ID NO: 696705 - DNA, 25 bp, Rattus norvegicus
ttttccacagagaccactttcttag

SEQ ID NO: 696706 - DNA, 25 bp, Rattus norvegicus
ttttccacagagtccactttcttag

SEQ ID NO: 696707 - DNA, 25 bp, Rattus norvegicus
ttttccacatgtcgcgcttctacaa

SEQ ID NO: 696708 - DNA, 25 bp, Rattus norvegicus
ttttccacatgtggcgcttctacaa

SEQ ID NO: 696709 - DNA, 25 bp, Rattus norvegicus
ttttccaccaagataacctcatctg

SEQ ID NO: 696710 - DNA, 25 bp, Rattus norvegicus
ttttccaccaagttaacctcatctg

SEQ ID NO: 696711 - DNA, 25 bp, Rattus norvegicus
ttttccaccaatcggcagtcagtca

SEQ ID NO: 696712 - DNA, 25 bp, Rattus norvegicus
ttttccaccaatgggcagtcagtca

SEQ ID NO: 696713 - DNA, 25 bp, Rattus norvegicus
ttttccaccaccagtcacaggatag

SEQ ID NO: 696714 - DNA, 25 bp, Rattus norvegicus
ttttccaccacctgtcacaggatag

SEQ ID NO: 696715 - DNA, 25 bp, Rattus norvegicus
ttttccaccagaccacgtcttgaag

SEQ ID NO: 696716 - DNA, 25 bp, Rattus norvegicus
ttttccaccagagcacgtcttgaag

SEQ ID NO: 696717 - DNA, 25 bp, Rattus norvegicus
ttttccaccatgctttatgtgattg

SEQ ID NO: 696718 - DNA, 25 bp, Rattus norvegicus
ttttccaccatggtttatgtgattg

SEQ ID NO: 696719 - DNA, 25 bp, Rattus norvegicus
ttttccacctcgctgtaaaaatggt

SEQ ID NO: 696720 - DNA, 25 bp, Rattus norvegicus
ttttccacctcggtgtaaaaatggt

SEQ ID NO: 696721 - DNA, 25 bp, Rattus norvegicus
ttttccacggcgactcagagattga

SEQ ID NO: 696722 - DNA, 25 bp, Rattus norvegicus
ttttccacggcgtctcagagattga

SEQ ID NO: 696723 - DNA, 25 bp, Rattus norvegicus
ttttccacgttcacgaggcttttca

SEQ ID NO: 696724 - DNA, 25 bp, Rattus norvegicus
ttttccacgttctcgaggcttttca

SEQ ID NO: 696725 - DNA, 25 bp, Rattus norvegicus
ttttccactcgtaatgacccaaata

SEQ ID NO: 696726 - DNA, 25 bp, Rattus norvegicus
ttttccactcgttatgacccaaata

SEQ ID NO: 696727 - DNA, 25 bp, Rattus norvegicus
ttttccacttgcatcttagagagag

SEQ ID NO: 696728 - DNA, 25 bp, Rattus norvegicus
ttttccacttgcttcttagagagag

SEQ ID NO: 696729 - DNA, 25 bp, Rattus norvegicus
ttttccagccatcaccttgggtcaa

SEQ ID NO: 696730 - DNA, 25 bp, Rattus norvegicus
ttttccagccatgaccttgggtcaa

SEQ ID NO: 696731 - DNA, 25 bp, Rattus norvegicus
ttttccagggaccatcacatactgt

SEQ ID NO: 696732 - DNA, 25 bp, Rattus norvegicus
ttttccagggacgatcacatactgt

SEQ ID NO: 696733 - DNA, 25 bp, Rattus norvegicus
ttttccagtcccaaatcatcatctg

SEQ ID NO: 696734 - DNA, 25 bp, Rattus norvegicus
ttttccagtccctaatcatcatctg

SEQ ID NO: 696735 - DNA, 25 bp, Rattus norvegicus
ttttccagtctaaaccaaggcaggt

SEQ ID NO: 696736 - DNA, 25 bp, Rattus norvegicus
ttttccagtctataccaaggcaggt

SEQ ID NO: 696737 - DNA, 25 bp, Rattus norvegicus
ttttccagttgaacttctcccttta

SEQ ID NO: 696738 - DNA, 25 bp, Rattus norvegicus
ttttccagttgatcttctcccttta

SEQ ID NO: 696739 - DNA, 25 bp, Rattus norvegicus
ttttccagttgcatctacatcattg

SEQ ID NO: 696740 - DNA, 25 bp, Rattus norvegicus
ttttccagttgcttctacatcattg

SEQ ID NO: 696741 - DNA, 25 bp, Rattus norvegicus
ttttccatagtgattctctctgtta

SEQ ID NO: 696742 - DNA, 25 bp, Rattus norvegicus
ttttccatagtgtttctctctgtta

SEQ ID NO: 696743 - DNA, 25 bp, Rattus norvegicus
ttttccatatagcagttctttccaa

SEQ ID NO: 696744 - DNA, 25 bp, Rattus norvegicus
ttttccatataggagttctttccaa

SEQ ID NO: 696745 - DNA, 25 bp, Rattus norvegicus
ttttccatctacagtgaccattttt

SEQ ID NO: 696746 - DNA, 25 bp, Rattus norvegicus
ttttccatctactgtgaccattttt

SEQ ID NO: 696747 - DNA, 25 bp, Rattus norvegicus
ttttccatctggctcattatcctta

SEQ ID NO: 696748 - DNA, 25 bp, Rattus norvegicus
ttttccatctgggtcattatcctta

SEQ ID NO: 696749 - DNA, 25 bp, Rattus norvegicus
ttttccatgcccctgtggtacagtg

SEQ ID NO: 696750 - DNA, 25 bp, Rattus norvegicus
ttttccatgcccgtgtggtacagtg

SEQ ID NO: 696751 - DNA, 25 bp, Rattus norvegicus
ttttccatgcctacatacagagctt

SEQ ID NO: 696752 - DNA, 25 bp, Rattus norvegicus
ttttccatgccttcatacagagctt

SEQ ID NO: 696753 - DNA, 25 bp, Rattus norvegicus
ttttccatgtcactgcccagcactt

SEQ ID NO: 696754 - DNA, 25 bp, Rattus norvegicus
ttttccatgtcagtgcccagcactt

SEQ ID NO: 696755 - DNA, 25 bp, Rattus norvegicus
ttttccatgtcgcacggattcctaa

SEQ ID NO: 696756 - DNA, 25 bp, Rattus norvegicus
ttttccatgtcggacggattcctaa

SEQ ID NO: 696757 - DNA, 25 bp, Rattus norvegicus
ttttccatgtctacagcaatgccgg

SEQ ID NO: 696758 - DNA, 25 bp, Rattus norvegicus
ttttccatgtcttcagcaatgccgg

SEQ ID NO: 696759 - DNA, 25 bp, Rattus norvegicus
ttttccattatgaccactgacagga

SEQ ID NO: 696760 - DNA, 25 bp, Rattus norvegicus
ttttccattatgtccactgacagga

SEQ ID NO: 696761 - DNA, 25 bp, Rattus norvegicus
ttttccattcctatgtcaaagacag

SEQ ID NO: 696762 - DNA, 25 bp, Rattus norvegicus
ttttccattcctttgtcaaagacag

SEQ ID NO: 696763 - DNA, 25 bp, Rattus norvegicus
ttttccattctacaccatggtaaaa

SEQ ID NO: 696764 - DNA, 25 bp, Rattus norvegicus
ttttccattctagaccatggtaaaa

SEQ ID NO: 696765 - DNA, 25 bp, Rattus norvegicus
ttttccattctcacactgcagagta

SEQ ID NO: 696766 - DNA, 25 bp, Rattus norvegicus
ttttccattctctcactgcagagta

SEQ ID NO: 696767 - DNA, 25 bp, Rattus norvegicus
ttttccattgaaatcttgtgttgta

SEQ ID NO: 696768 - DNA, 25 bp, Rattus norvegicus
ttttccattgaattcttgtgttgta

SEQ ID NO: 696769 - DNA, 25 bp, Rattus norvegicus
ttttccattgttacttgcgacttgt

SEQ ID NO: 696770 - DNA, 25 bp, Rattus norvegicus
ttttccattgtttcttgcgacttgt

SEQ ID NO: 696771 - DNA, 25 bp, Rattus norvegicus
ttttcccaaatgagtagctgttccc

SEQ ID NO: 696772 - DNA, 25 bp, Rattus norvegicus
ttttcccaaatgtgtagctgttccc

SEQ ID NO: 696773 - DNA, 25 bp, Rattus norvegicus
ttttcccaaggaactcaagagcggt

SEQ ID NO: 696774 - DNA, 25 bp, Rattus norvegicus
ttttcccaaggatctcaagagcggt

SEQ ID NO: 696775 - DNA, 25 bp, Rattus norvegicus
ttttcccacaaacacactcagatat

SEQ ID NO: 696776 - DNA, 25 bp, Rattus norvegicus
ttttcccacaaagacactcagatat

SEQ ID NO: 696777 - DNA, 25 bp, Rattus norvegicus
ttttcccacaggaccatgtctttgg

SEQ ID NO: 696778 - DNA, 25 bp, Rattus norvegicus
ttttcccacaggtccatgtctttgg

SEQ ID NO: 696779 - DNA, 25 bp, Rattus norvegicus
ttttcccacatcaagtttgagactt

SEQ ID NO: 696780 - DNA, 25 bp, Rattus norvegicus
ttttcccacatctagtttgagactt

SEQ ID NO: 696781 - DNA, 25 bp, Rattus norvegicus
ttttcccaccgtccagagaatctgt

SEQ ID NO: 696782 - DNA, 25 bp, Rattus norvegicus
ttttcccaccgtgcagagaatctgt

SEQ ID NO: 696783 - DNA, 25 bp, Rattus norvegicus
ttttcccacctgcaacgtagagatg

SEQ ID NO: 696784 - DNA, 25 bp, Rattus norvegicus
ttttcccacctggaacgtagagatg

SEQ ID NO: 696785 - DNA, 25 bp, Rattus norvegicus
ttttcccacgaacaggaccctgatc

SEQ ID NO: 696786 - DNA, 25 bp, Rattus norvegicus
ttttcccacgaagaggaccctgatc

SEQ ID NO: 696787 - DNA, 25 bp, Rattus norvegicus
ttttcccactaacatgacagcagct

SEQ ID NO: 696788 - DNA, 25 bp, Rattus norvegicus
ttttcccactaagatgacagcagct

SEQ ID NO: 696789 - DNA, 25 bp, Rattus norvegicus
ttttcccactgacccttcaaggatg

SEQ ID NO: 696790 - DNA, 25 bp, Rattus norvegicus
ttttcccactgagccttcaaggatg

SEQ ID NO: 696791 - DNA, 25 bp, Rattus norvegicus
ttttcccactgccaaatgtcttgga

SEQ ID NO: 696792 - DNA, 25 bp, Rattus norvegicus
ttttcccactgcgaaatgtcttgga

SEQ ID NO: 696793 - DNA, 25 bp, Rattus norvegicus
ttttcccagccacttgaaaggttga

SEQ ID NO: 696794 - DNA, 25 bp, Rattus norvegicus
ttttcccagccagttgaaaggttga

SEQ ID NO: 696795 - DNA, 25 bp, Rattus norvegicus
ttttcccaggaaagtctacacgtgt

SEQ ID NO: 696796 - DNA, 25 bp, Rattus norvegicus
ttttcccaggaatgtctacacgtgt

SEQ ID NO: 696797 - DNA, 25 bp, Rattus norvegicus
ttttcccaggcaccacatctggctt

SEQ ID NO: 696798 - DNA, 25 bp, Rattus norvegicus
ttttcccaggcagcacatctggctt

SEQ ID NO: 696799 - DNA, 25 bp, Rattus norvegicus
ttttcccagtgtatagatgatctca

SEQ ID NO: 696800 - DNA, 25 bp, Rattus norvegicus
ttttcccagtgtttagatgatctca

SEQ ID NO: 696801 - DNA, 25 bp, Rattus norvegicus
ttttcccatcaaagaatccttttct

SEQ ID NO: 696802 - DNA, 25 bp, Rattus norvegicus
ttttcccatcaatgaatccttttct

SEQ ID NO: 696803 - DNA, 25 bp, Rattus norvegicus
ttttcccatccaccctcttaagaat

SEQ ID NO: 696804 - DNA, 25 bp, Rattus norvegicus
ttttcccatccagcctcttaagaat

SEQ ID NO: 696805 - DNA, 25 bp, Rattus norvegicus
ttttcccatctaccagttgcagcgg

SEQ ID NO: 696806 - DNA, 25 bp, Rattus norvegicus
ttttcccatctagcagttgcagcgg

SEQ ID NO: 696807 - DNA, 25 bp, Rattus norvegicus
ttttcccatctgcagtcgacaagac

SEQ ID NO: 696808 - DNA, 25 bp, Rattus norvegicus
ttttcccatctggagtcgacaagac

SEQ ID NO: 696809 - DNA, 25 bp, Rattus norvegicus
ttttcccattagcaaagtagcccct

SEQ ID NO: 696810 - DNA, 25 bp, Rattus norvegicus
ttttcccattaggaaagtagcccct

SEQ ID NO: 696811 - DNA, 25 bp, Rattus norvegicus
ttttcccattctccagcagagaaag

SEQ ID NO: 696812 - DNA, 25 bp, Rattus norvegicus
ttttcccattctgcagcagagaaag

SEQ ID NO: 696813 - DNA, 25 bp, Rattus norvegicus
ttttccccaaggctaatgcccagag

SEQ ID NO: 696814 - DNA, 25 bp, Rattus norvegicus
ttttccccaagggtaatgcccagag

SEQ ID NO: 696815 - DNA, 25 bp, Rattus norvegicus
ttttccccaatacaaggcttttatg

SEQ ID NO: 696816 - DNA, 25 bp, Rattus norvegicus
ttttccccaatagaaggcttttatg

SEQ ID NO: 696817 - DNA, 25 bp, Rattus norvegicus
ttttccccaatcctagttgtctatc

SEQ ID NO: 696818 - DNA, 25 bp, Rattus norvegicus
ttttccccaatcgtagttgtctatc

SEQ ID NO: 696819 - DNA, 25 bp, Rattus norvegicus
ttttccccacatagcttccttagaa

SEQ ID NO: 696820 - DNA, 25 bp, Rattus norvegicus
ttttccccacattgcttccttagaa

SEQ ID NO: 696821 - DNA, 25 bp, Rattus norvegicus
ttttccccacgcagctgaaagttga

SEQ ID NO: 696822 - DNA, 25 bp, Rattus norvegicus
ttttccccacgcagtctaagggcaa

SEQ ID NO: 696823 - DNA, 25 bp, Rattus norvegicus
ttttccccacgctgctgaaagttga

SEQ ID NO: 696824 - DNA, 25 bp, Rattus norvegicus
ttttccccacgctgtctaagggcaa

SEQ ID NO: 696825 - DNA, 25 bp, Rattus norvegicus
ttttccccactgcagttcactgaag

SEQ ID NO: 696826 - DNA, 25 bp, Rattus norvegicus
ttttccccactggagttcactgaag

SEQ ID NO: 696827 - DNA, 25 bp, Rattus norvegicus
ttttccccagaaaagagtcccaatt

SEQ ID NO: 696828 - DNA, 25 bp, Rattus norvegicus
ttttccccagaatagagtcccaatt

SEQ ID NO: 696829 - DNA, 25 bp, Rattus norvegicus
ttttccccatttagtgctccaagca

SEQ ID NO: 696830 - DNA, 25 bp, Rattus norvegicus
ttttccccattttgtgctccaagca

SEQ ID NO: 696831 - DNA, 25 bp, Rattus norvegicus
ttttccccgactcactaaatagctt

SEQ ID NO: 696832 - DNA, 25 bp, Rattus norvegicus
ttttccccgactgactaaatagctt

SEQ ID NO: 696833 - DNA, 25 bp, Rattus norvegicus
ttttccccgatgactttttagcaat

SEQ ID NO: 696834 - DNA, 25 bp, Rattus norvegicus
ttttccccgatgtctttttagcaat

SEQ ID NO: 696835 - DNA, 25 bp, Rattus norvegicus
ttttcccctcaaatatttagtgtgt

SEQ ID NO: 696836 - DNA, 25 bp, Rattus norvegicus
ttttcccctcaattatttagtgtgt

SEQ ID NO: 696837 - DNA, 25 bp, Rattus norvegicus
ttttcccctccaaacatttgttgat

SEQ ID NO: 696838 - DNA, 25 bp, Rattus norvegicus
ttttcccctccatacatttgttgat

SEQ ID NO: 696839 - DNA, 25 bp, Rattus norvegicus
ttttcccctctgcagagcctgacta

SEQ ID NO: 696840 - DNA, 25 bp, Rattus norvegicus
ttttcccctctggagagcctgacta

SEQ ID NO: 696841 - DNA, 25 bp, Rattus norvegicus
ttttcccctggtctggatgctaaaa

SEQ ID NO: 696842 - DNA, 25 bp, Rattus norvegicus
ttttcccctggtgtggatgctaaaa

SEQ ID NO: 696843 - DNA, 25 bp, Rattus norvegicus
ttttccccttaacaacctgcatttg

SEQ ID NO: 696844 - DNA, 25 bp, Rattus norvegicus
ttttccccttaagaacctgcatttg

SEQ ID NO: 696845 - DNA, 25 bp, Rattus norvegicus
ttttccccttatattcgatgtctct

SEQ ID NO: 696846 - DNA, 25 bp, Rattus norvegicus
ttttccccttattttcgatgtctct

SEQ ID NO: 696847 - DNA, 25 bp, Rattus norvegicus
ttttcccgtaggctataactccata

SEQ ID NO: 696848 - DNA, 25 bp, Rattus norvegicus
ttttcccgtagggtataactccata

SEQ ID NO: 696849 - DNA, 25 bp, Rattus norvegicus
ttttcccgttgccatagtgatatgt

SEQ ID NO: 696850 - DNA, 25 bp, Rattus norvegicus
ttttcccgttgcgatagtgatatgt

SEQ ID NO: 696851 - DNA, 25 bp, Rattus norvegicus
ttttccctaaagaaggtgtgtgaca

SEQ ID NO: 696852 - DNA, 25 bp, Rattus norvegicus
ttttccctaaagtaggtgtgtgaca

SEQ ID NO: 696853 - DNA, 25 bp, Rattus norvegicus
ttttccctaccaaacagctatgcaa

SEQ ID NO: 696854 - DNA, 25 bp, Rattus norvegicus
ttttccctaccatacagctatgcaa

SEQ ID NO: 696855 - DNA, 25 bp, Rattus norvegicus
ttttccctcatacctgacagtctga

SEQ ID NO: 696856 - DNA, 25 bp, Rattus norvegicus
ttttccctcatagctgacagtctga

SEQ ID NO: 696857 - DNA, 25 bp, Rattus norvegicus
ttttccctccaccaaacaggcagga

SEQ ID NO: 696858 - DNA, 25 bp, Rattus norvegicus
ttttccctccacgaaacaggcagga

SEQ ID NO: 696859 - DNA, 25 bp, Rattus norvegicus
ttttccctctcaaagttcacatgac

SEQ ID NO: 696860 - DNA, 25 bp, Rattus norvegicus
ttttccctctcatagttcacatgac

SEQ ID NO: 696861 - DNA, 25 bp, Rattus norvegicus
ttttccctctccagtcggtggtctc

SEQ ID NO: 696862 - DNA, 25 bp, Rattus norvegicus
ttttccctctcctgtcggtggtctc

SEQ ID NO: 696863 - DNA, 25 bp, Rattus norvegicus
ttttccctctgtacattatgcttta

SEQ ID NO: 696864 - DNA, 25 bp, Rattus norvegicus
ttttccctctgtccgaatgagcatg

SEQ ID NO: 696865 - DNA, 25 bp, Rattus norvegicus
ttttccctctgtgcgaatgagcatg

SEQ ID NO: 696866 - DNA, 25 bp, Rattus norvegicus
ttttccctctgttcattatgcttta

SEQ ID NO: 696867 - DNA, 25 bp, Rattus norvegicus
ttttccctcttcactaagcgtgttt

SEQ ID NO: 696868 - DNA, 25 bp, Rattus norvegicus
ttttccctcttctctaagcgtgttt

SEQ ID NO: 696869 - DNA, 25 bp, Rattus norvegicus
ttttccctgggtatctacggtacag

SEQ ID NO: 696870 - DNA, 25 bp, Rattus norvegicus
ttttccctgggtctgtgtttatata

SEQ ID NO: 696871 - DNA, 25 bp, Rattus norvegicus
ttttccctgggtgtgtgtttatata

SEQ ID NO: 696872 - DNA, 25 bp, Rattus norvegicus
ttttccctgggtttctacggtacag

SEQ ID NO: 696873 - DNA, 25 bp, Rattus norvegicus
ttttcccttaccattgagcgcagga

SEQ ID NO: 696874 - DNA, 25 bp, Rattus norvegicus
ttttcccttacctttgagcgcagga

SEQ ID NO: 696875 - DNA, 25 bp, Rattus norvegicus
ttttcccttcttctagtaagcgctc

SEQ ID NO: 696876 - DNA, 25 bp, Rattus norvegicus
ttttcccttcttgtagtaagcgctc

SEQ ID NO: 696877 - DNA, 25 bp, Rattus norvegicus
ttttcccttgaaacatatcagaatt

SEQ ID NO: 696878 - DNA, 25 bp, Rattus norvegicus
ttttcccttgaatcatatcagaatt

SEQ ID NO: 696879 - DNA, 25 bp, Rattus norvegicus
ttttcccttgagctgatttccttaa

SEQ ID NO: 696880 - DNA, 25 bp, Rattus norvegicus
ttttcccttgaggtgatttccttaa

SEQ ID NO: 696881 - DNA, 25 bp, Rattus norvegicus
ttttcccttgtgagcactctaataa

SEQ ID NO: 696882 - DNA, 25 bp, Rattus norvegicus
ttttcccttgtgtgcactctaataa

SEQ ID NO: 696883 - DNA, 25 bp, Rattus norvegicus
ttttccctttatcctgcctttcaga

SEQ ID NO: 696884 - DNA, 25 bp, Rattus norvegicus
ttttccctttatgctgcctttcaga

SEQ ID NO: 696885 - DNA, 25 bp, Rattus norvegicus
ttttcccttttgagctgccaaaatt

SEQ ID NO: 696886 - DNA, 25 bp, Rattus norvegicus
ttttcccttttgtgctgccaaaatt

SEQ ID NO: 696887 - DNA, 25 bp, Rattus norvegicus
ttttccgaacaaacctagtagagag

SEQ ID NO: 696888 - DNA, 25 bp, Rattus norvegicus
ttttccgaacaatcctagtagagag

SEQ ID NO: 696889 - DNA, 25 bp, Rattus norvegicus
ttttccgagtgtcagctgtgcaggc

SEQ ID NO: 696890 - DNA, 25 bp, Rattus norvegicus
ttttccgagtgtgagctgtgcaggc

SEQ ID NO: 696891 - DNA, 25 bp, Rattus norvegicus
ttttccgctccaagcccggatataa

SEQ ID NO: 696892 - DNA, 25 bp, Rattus norvegicus
ttttccgctccatgcccggatataa

SEQ ID NO: 696893 - DNA, 25 bp, Rattus norvegicus
ttttccggaagcagagcagggcgca

SEQ ID NO: 696894 - DNA, 25 bp, Rattus norvegicus
ttttccggaagctgagcagggcgca

SEQ ID NO: 696895 - DNA, 25 bp, Rattus norvegicus
ttttccggagcacggccagagcaac

SEQ ID NO: 696896 - DNA, 25 bp, Rattus norvegicus
ttttccggagcagggccagagcaac

SEQ ID NO: 696897 - DNA, 25 bp, Rattus norvegicus
ttttccgggcccagagacttacatt

SEQ ID NO: 696898 - DNA, 25 bp, Rattus norvegicus
ttttccgggccctgagacttacatt

SEQ ID NO: 696899 - DNA, 25 bp, Rattus norvegicus
ttttccgtattcctttttgcctctg

SEQ ID NO: 696900 - DNA, 25 bp, Rattus norvegicus
ttttccgtattcgtttttgcctctg

SEQ ID NO: 696901 - DNA, 25 bp, Rattus norvegicus
ttttccgtgttgctgtactagtgac

SEQ ID NO: 696902 - DNA, 25 bp, Rattus norvegicus
ttttccgtgttggtgtactagtgac

SEQ ID NO: 696903 - DNA, 25 bp, Rattus norvegicus
ttttccgttcctccagagctgatac

SEQ ID NO: 696904 - DNA, 25 bp, Rattus norvegicus
ttttccgttcctgcagagctgatac

SEQ ID NO: 696905 - DNA, 25 bp, Rattus norvegicus
ttttccgttgccatgcatgacagaa

SEQ ID NO: 696906 - DNA, 25 bp, Rattus norvegicus
ttttccgttgccttgcatgacagaa

SEQ ID NO: 696907 - DNA, 25 bp, Rattus norvegicus
ttttcctaaaacagccctggctttg

SEQ ID NO: 696908 - DNA, 25 bp, Rattus norvegicus
ttttcctaaaactgccctggctttg

SEQ ID NO: 696909 - DNA, 25 bp, Rattus norvegicus
ttttcctaacagatcactctgggtc

SEQ ID NO: 696910 - DNA, 25 bp, Rattus norvegicus
ttttcctaacagttcactctgggtc

SEQ ID NO: 696911 - DNA, 25 bp, Rattus norvegicus
ttttcctaacttaccagctgcttaa

SEQ ID NO: 696912 - DNA, 25 bp, Rattus norvegicus
ttttcctaactttccagctgcttaa

SEQ ID NO: 696913 - DNA, 25 bp, Rattus norvegicus
ttttcctaagagacaatcgactatg

SEQ ID NO: 696914 - DNA, 25 bp, Rattus norvegicus
ttttcctaagagacagcctgaagct

SEQ ID NO: 696915 - DNA, 25 bp, Rattus norvegicus
ttttcctaagagtcaatcgactatg

SEQ ID NO: 696916 - DNA, 25 bp, Rattus norvegicus
ttttcctaagagtcagcctgaagct

SEQ ID NO: 696917 - DNA, 25 bp, Rattus norvegicus
ttttcctaattaatttgcctgccag

SEQ ID NO: 696918 - DNA, 25 bp, Rattus norvegicus
ttttcctaattattttgcctgccag

SEQ ID NO: 696919 - DNA, 25 bp, Rattus norvegicus
ttttcctaattcatcacctggttgt

SEQ ID NO: 696920 - DNA, 25 bp, Rattus norvegicus
ttttcctaattcttcacctggttgt

SEQ ID NO: 696921 - DNA, 25 bp, Rattus norvegicus
ttttcctacacaagtctctgagcca

SEQ ID NO: 696922 - DNA, 25 bp, Rattus norvegicus
ttttcctacacatgtctctgagcca

SEQ ID NO: 696923 - DNA, 25 bp, Rattus norvegicus
ttttcctacctgcttctggaagtct

SEQ ID NO: 696924 - DNA, 25 bp, Rattus norvegicus
ttttcctacctggttctggaagtct

SEQ ID NO: 696925 - DNA, 25 bp, Rattus norvegicus
ttttcctactaccaacttcaagctt

SEQ ID NO: 696926 - DNA, 25 bp, Rattus norvegicus
ttttcctactacgaacttcaagctt

SEQ ID NO: 696927 - DNA, 25 bp, Rattus norvegicus
ttttcctactcaaagccaaccaata

SEQ ID NO: 696928 - DNA, 25 bp, Rattus norvegicus
ttttcctactcatagccaaccaata

SEQ ID NO: 696929 - DNA, 25 bp, Rattus norvegicus
ttttcctactccctcagattatgta

SEQ ID NO: 696930 - DNA, 25 bp, Rattus norvegicus
ttttcctactccgtcagattatgta

SEQ ID NO: 696931 - DNA, 25 bp, Rattus norvegicus
ttttcctagacaacgcagacagctc

SEQ ID NO: 696932 - DNA, 25 bp, Rattus norvegicus
ttttcctagacatcgcagacagctc

SEQ ID NO: 696933 - DNA, 25 bp, Rattus norvegicus
ttttcctagactctgtcctacagtg

SEQ ID NO: 696934 - DNA, 25 bp, Rattus norvegicus
ttttcctagactgtgtcctacagtg

SEQ ID NO: 696935 - DNA, 25 bp, Rattus norvegicus
ttttcctagctgagaagccgttttc

SEQ ID NO: 696936 - DNA, 25 bp, Rattus norvegicus
ttttcctagctgtgaagccgttttc

SEQ ID NO: 696937 - DNA, 25 bp, Rattus norvegicus
ttttcctatcagagagtcaactcaa

SEQ ID NO: 696938 - DNA, 25 bp, Rattus norvegicus
ttttcctatcagtgagtcaactcaa

SEQ ID NO: 696939 - DNA, 25 bp, Rattus norvegicus
ttttcctcaaatcgcacctatgtag

SEQ ID NO: 696940 - DNA, 25 bp, Rattus norvegicus
ttttcctcaaatggcacctatgtag

SEQ ID NO: 696941 - DNA, 25 bp, Rattus norvegicus
ttttcctcaccaccagtgggatatt

SEQ ID NO: 696942 - DNA, 25 bp, Rattus norvegicus
ttttcctcaccagcagtgggatatt

SEQ ID NO: 696943 - DNA, 25 bp, Rattus norvegicus
ttttcctcacctacctaagttctag

SEQ ID NO: 696944 - DNA, 25 bp, Rattus norvegicus
ttttcctcaccttcctaagttctag

SEQ ID NO: 696945 - DNA, 25 bp, Rattus norvegicus
ttttcctcacgtcccacaacaggtg

SEQ ID NO: 696946 - DNA, 25 bp, Rattus norvegicus
ttttcctcacgtgccacaacaggtg

SEQ ID NO: 696947 - DNA, 25 bp, Rattus norvegicus
ttttcctcagaactggcttactaac

SEQ ID NO: 696948 - DNA, 25 bp, Rattus norvegicus
ttttcctcagaagtggcttactaac

SEQ ID NO: 696949 - DNA, 25 bp, Rattus norvegicus
ttttcctcagctcaagtcatgtcag

SEQ ID NO: 696950 - DNA, 25 bp, Rattus norvegicus
ttttcctcagctgaagtcatgtcag

SEQ ID NO: 696951 - DNA, 25 bp, Rattus norvegicus
ttttcctcagttatggtggccctct

SEQ ID NO: 696952 - DNA, 25 bp, Rattus norvegicus
ttttcctcagttttggtggccctct

SEQ ID NO: 696953 - DNA, 25 bp, Rattus norvegicus
ttttcctcatcccatttaatcattg

SEQ ID NO: 696954 - DNA, 25 bp, Rattus norvegicus
ttttcctcatccgatttaatcattg

SEQ ID NO: 696955 - DNA, 25 bp, Rattus norvegicus
ttttcctcatctcttctattactaa

SEQ ID NO: 696956 - DNA, 25 bp, Rattus norvegicus
ttttcctcatctgttctattactaa

SEQ ID NO: 696957 - DNA, 25 bp, Rattus norvegicus
ttttcctcatgccaaagtgttctta

SEQ ID NO: 696958 - DNA, 25 bp, Rattus norvegicus
ttttcctcatgcgaaagtgttctta

SEQ ID NO: 696959 - DNA, 25 bp, Rattus norvegicus
ttttcctccatcacagagccaaggt

SEQ ID NO: 696960 - DNA, 25 bp, Rattus norvegicus
ttttcctccatctcagagccaaggt

SEQ ID NO: 696961 - DNA, 25 bp, Rattus norvegicus
ttttcctccctactgttgtctagat

SEQ ID NO: 696962 - DNA, 25 bp, Rattus norvegicus
ttttcctccctagtgttgtctagat

SEQ ID NO: 696963 - DNA, 25 bp, Rattus norvegicus
ttttcctcctgaaatcagacttagt

SEQ ID NO: 696964 - DNA, 25 bp, Rattus norvegicus
ttttcctcctgatatcagacttagt

SEQ ID NO: 696965 - DNA, 25 bp, Rattus norvegicus
ttttcctcgactactgcagcagacg

SEQ ID NO: 696966 - DNA, 25 bp, Rattus norvegicus
ttttcctcgacttctgcagcagacg

SEQ ID NO: 696967 - DNA, 25 bp, Rattus norvegicus
ttttcctctaccaagtaagcactgc

SEQ ID NO: 696968 - DNA, 25 bp, Rattus norvegicus
ttttcctctacctagtaagcactgc

SEQ ID NO: 696969 - DNA, 25 bp, Rattus norvegicus
ttttcctctcatcgcagtgtttaat

SEQ ID NO: 696970 - DNA, 25 bp, Rattus norvegicus
ttttcctctcatggcagtgtttaat

SEQ ID NO: 696971 - DNA, 25 bp, Rattus norvegicus
ttttcctctccaagccgctcaggga

SEQ ID NO: 696972 - DNA, 25 bp, Rattus norvegicus
ttttcctctccatgccgctcaggga

SEQ ID NO: 696973 - DNA, 25 bp, Rattus norvegicus
ttttcctctcctaccattttaacag

SEQ ID NO: 696974 - DNA, 25 bp, Rattus norvegicus
ttttcctctccttccattttaacag

SEQ ID NO: 696975 - DNA, 25 bp, Rattus norvegicus
ttttcctctcgtcctcactagaaaa

SEQ ID NO: 696976 - DNA, 25 bp, Rattus norvegicus
ttttcctctcgtgctcactagaaaa

SEQ ID NO: 696977 - DNA, 25 bp, Rattus norvegicus
ttttcctcttccagtttctgttaga

SEQ ID NO: 696978 - DNA, 25 bp, Rattus norvegicus
ttttcctcttcctgtttctgttaga

SEQ ID NO: 696979 - DNA, 25 bp, Rattus norvegicus
ttttcctctttcatctcatcctggg

SEQ ID NO: 696980 - DNA, 25 bp, Rattus norvegicus
ttttcctctttcttctcatcctggg

SEQ ID NO: 696981 - DNA, 25 bp, Rattus norvegicus
ttttcctgaaacatctgtgtggaag

SEQ ID NO: 696982 - DNA, 25 bp, Rattus norvegicus
ttttcctgaaacttctgtgtggaag

SEQ ID NO: 696983 - DNA, 25 bp, Rattus norvegicus
ttttcctgacgtagttcctcgaaca

SEQ ID NO: 696984 - DNA, 25 bp, Rattus norvegicus
ttttcctgacgttgttcctcgaaca

SEQ ID NO: 696985 - DNA, 25 bp, Rattus norvegicus
ttttcctgagagatcttgtccagta

SEQ ID NO: 696986 - DNA, 25 bp, Rattus norvegicus
ttttcctgagagttcttgtccagta

SEQ ID NO: 696987 - DNA, 25 bp, Rattus norvegicus
ttttcctgagttactatgggaagaa

SEQ ID NO: 696988 - DNA, 25 bp, Rattus norvegicus
ttttcctgagtttctatgggaagaa

SEQ ID NO: 696989 - DNA, 25 bp, Rattus norvegicus
ttttcctgcaacacagagctcagtg

SEQ ID NO: 696990 - DNA, 25 bp, Rattus norvegicus
ttttcctgcaactcagagctcagtg

SEQ ID NO: 696991 - DNA, 25 bp, Rattus norvegicus
ttttcctgcatacttcagcttcctt

SEQ ID NO: 696992 - DNA, 25 bp, Rattus norvegicus
ttttcctgcatagttcagcttcctt

SEQ ID NO: 696993 - DNA, 25 bp, Rattus norvegicus
ttttcctgcccaatatcacctggaa

SEQ ID NO: 696994 - DNA, 25 bp, Rattus norvegicus
ttttcctgcccattatcacctggaa

SEQ ID NO: 696995 - DNA, 25 bp, Rattus norvegicus
ttttcctgctttcgtggttaactag

SEQ ID NO: 696996 - DNA, 25 bp, Rattus norvegicus
ttttcctgctttctaagactgctgc

SEQ ID NO: 696997 - DNA, 25 bp, Rattus norvegicus
ttttcctgctttggtggttaactag

SEQ ID NO: 696998 - DNA, 25 bp, Rattus norvegicus
ttttcctgctttgtaagactgctgc

SEQ ID NO: 696999 - DNA, 25 bp, Rattus norvegicus
ttttcctggcacacaaactcaagac

SEQ ID NO: 697000 - DNA, 25 bp, Rattus norvegicus
ttttcctggcactcaaactcaagac

SEQ ID NO: 697001 - DNA, 25 bp, Rattus norvegicus
ttttcctgggacacaacgacgacat

SEQ ID NO: 697002 - DNA, 25 bp, Rattus norvegicus
ttttcctgggactcaacgacgacat

SEQ ID NO: 697003 - DNA, 25 bp, Rattus norvegicus
ttttcctgggctagggttggagctt

SEQ ID NO: 697004 - DNA, 25 bp, Rattus norvegicus
ttttcctgggcttgggttggagctt

SEQ ID NO: 697005 - DNA, 25 bp, Rattus norvegicus
ttttcctggggaacctaaagcattg

SEQ ID NO: 697006 - DNA, 25 bp, Rattus norvegicus
ttttcctggggatcctaaagcattg

SEQ ID NO: 697007 - DNA, 25 bp, Rattus norvegicus
ttttcctgggtgcatctctaaagga

SEQ ID NO: 697008 - DNA, 25 bp, Rattus norvegicus
ttttcctgggtggatctctaaagga

SEQ ID NO: 697009 - DNA, 25 bp, Rattus norvegicus
ttttcctgggttcatccacctggaa

SEQ ID NO: 697010 - DNA, 25 bp, Rattus norvegicus
ttttcctgggttgatccacctggaa

SEQ ID NO: 697011 - DNA, 25 bp, Rattus norvegicus
ttttcctggtgtcggttagcaacta

SEQ ID NO: 697012 - DNA, 25 bp, Rattus norvegicus
ttttcctggtgtgggttagcaacta

SEQ ID NO: 697013 - DNA, 25 bp, Rattus norvegicus
ttttcctgtaatctcccgctactga

SEQ ID NO: 697014 - DNA, 25 bp, Rattus norvegicus
ttttcctgtaatgtcccgctactga

SEQ ID NO: 697015 - DNA, 25 bp, Rattus norvegicus
ttttcctgtaggacccaccataggg

SEQ ID NO: 697016 - DNA, 25 bp, Rattus norvegicus
ttttcctgtaggtcccaccataggg

SEQ ID NO: 697017 - DNA, 25 bp, Rattus norvegicus
ttttcctgtccaacagccaaaaatc

SEQ ID NO: 697018 - DNA, 25 bp, Rattus norvegicus
ttttcctgtccatcagccaaaaatc

SEQ ID NO: 697019 - DNA, 25 bp, Rattus norvegicus
ttttcctgtctaaattctgcccaag

SEQ ID NO: 697020 - DNA, 25 bp, Rattus norvegicus
ttttcctgtctatattctgcccaag

SEQ ID NO: 697021 - DNA, 25 bp, Rattus norvegicus
ttttcctgtggacgccgagcagtga

SEQ ID NO: 697022 - DNA, 25 bp, Rattus norvegicus
ttttcctgtggaggccgagcagtga

SEQ ID NO: 697023 - DNA, 25 bp, Rattus norvegicus
ttttcctgtggcattaatttatcta

SEQ ID NO: 697024 - DNA, 25 bp, Rattus norvegicus
ttttcctgtggctttaatttatcta

SEQ ID NO: 697025 - DNA, 25 bp, Rattus norvegicus
ttttcctgtgtaaatattggacttt

SEQ ID NO: 697026 - DNA, 25 bp, Rattus norvegicus
ttttcctgtgtatatattggacttt

SEQ ID NO: 697027 - DNA, 25 bp, Rattus norvegicus
ttttcctgtgtgcaagcctttctaa

SEQ ID NO: 697028 - DNA, 25 bp, Rattus norvegicus
ttttcctgtgtggaagcctttctaa

SEQ ID NO: 697029 - DNA, 25 bp, Rattus norvegicus
ttttccttaaccagcctagcttggg

SEQ ID NO: 697030 - DNA, 25 bp, Rattus norvegicus
ttttccttaacctgcctagcttggg

SEQ ID NO: 697031 - DNA, 25 bp, Rattus norvegicus
ttttccttactgagtgagggctgct

SEQ ID NO: 697032 - DNA, 25 bp, Rattus norvegicus
ttttccttactgtgtgagggctgct

SEQ ID NO: 697033 - DNA, 25 bp, Rattus norvegicus
ttttccttagacatgttccttgctt

SEQ ID NO: 697034 - DNA, 25 bp, Rattus norvegicus
ttttccttagacttgttccttgctt

SEQ ID NO: 697035 - DNA, 25 bp, Rattus norvegicus
ttttccttagctacttttcttacag

SEQ ID NO: 697036 - DNA, 25 bp, Rattus norvegicus
ttttccttagcttcttttcttacag

SEQ ID NO: 697037 - DNA, 25 bp, Rattus norvegicus
ttttccttaggacactgttgtttga

SEQ ID NO: 697038 - DNA, 25 bp, Rattus norvegicus
ttttccttaggagactgttgtttga

SEQ ID NO: 697039 - DNA, 25 bp, Rattus norvegicus
ttttccttcatgctactaggtggct

SEQ ID NO: 697040 - DNA, 25 bp, Rattus norvegicus
ttttccttcatggtactaggtggct

SEQ ID NO: 697041 - DNA, 25 bp, Rattus norvegicus
ttttccttcattaacgtggtggtag

SEQ ID NO: 697042 - DNA, 25 bp, Rattus norvegicus
ttttccttcattatctcctaattgg

SEQ ID NO: 697043 - DNA, 25 bp, Rattus norvegicus
ttttccttcatttacgtggtggtag

SEQ ID NO: 697044 - DNA, 25 bp, Rattus norvegicus
ttttccttcattttctcctaattgg

SEQ ID NO: 697045 - DNA, 25 bp, Rattus norvegicus
ttttccttccaaattcactatttat

SEQ ID NO: 697046 - DNA, 25 bp, Rattus norvegicus
ttttccttccaacacttcttgattg

SEQ ID NO: 697047 - DNA, 25 bp, Rattus norvegicus
ttttccttccaagacttcttgattg

SEQ ID NO: 697048 - DNA, 25 bp, Rattus norvegicus
ttttccttccaatttcactatttat

SEQ ID NO: 697049 - DNA, 25 bp, Rattus norvegicus
ttttccttccgcacataggtttgaa

SEQ ID NO: 697050 - DNA, 25 bp, Rattus norvegicus
ttttccttccgcagtgtacacattt

SEQ ID NO: 697051 - DNA, 25 bp, Rattus norvegicus
ttttccttccgctcataggtttgaa

SEQ ID NO: 697052 - DNA, 25 bp, Rattus norvegicus
ttttccttccgctgtgtacacattt

SEQ ID NO: 697053 - DNA, 25 bp, Rattus norvegicus
ttttccttccgtagaagcccacttg

SEQ ID NO: 697054 - DNA, 25 bp, Rattus norvegicus
ttttccttccgttgaagcccacttg

SEQ ID NO: 697055 - DNA, 25 bp, Rattus norvegicus
ttttccttctccctattagaactgc

SEQ ID NO: 697056 - DNA, 25 bp, Rattus norvegicus
ttttccttctccgtattagaactgc

SEQ ID NO: 697057 - DNA, 25 bp, Rattus norvegicus
ttttccttcttcaacatcgtctatt

SEQ ID NO: 697058 - DNA, 25 bp, Rattus norvegicus
ttttccttcttctacatcgtctatt

SEQ ID NO: 697059 - DNA, 25 bp, Rattus norvegicus
ttttccttggacacaaagacctcaa

SEQ ID NO: 697060 - DNA, 25 bp, Rattus norvegicus
ttttccttggactcaaagacctcaa

SEQ ID NO: 697061 - DNA, 25 bp, Rattus norvegicus
ttttccttggatcggtgtctcagta

SEQ ID NO: 697062 - DNA, 25 bp, Rattus norvegicus
ttttccttggatgggtgtctcagta

SEQ ID NO: 697063 - DNA, 25 bp, Rattus norvegicus
ttttcctttagccttctgagacttc

SEQ ID NO: 697064 - DNA, 25 bp, Rattus norvegicus
ttttcctttagcgttctgagacttc

SEQ ID NO: 697065 - DNA, 25 bp, Rattus norvegicus
ttttcctttagtcctcttgtgaagc

SEQ ID NO: 697066 - DNA, 25 bp, Rattus norvegicus
ttttcctttagtgctcttgtgaagc

SEQ ID NO: 697067 - DNA, 25 bp, Rattus norvegicus
ttttcctttatcaatcaatcccctg

SEQ ID NO: 697068 - DNA, 25 bp, Rattus norvegicus
ttttcctttatctatcaatcccctg

SEQ ID NO: 697069 - DNA, 25 bp, Rattus norvegicus
ttttcctttattatgtgcaacagta

SEQ ID NO: 697070 - DNA, 25 bp, Rattus norvegicus
ttttcctttattttgtgcaacagta

SEQ ID NO: 697071 - DNA, 25 bp, Rattus norvegicus
ttttcctttcagaatattttccaga

SEQ ID NO: 697072 - DNA, 25 bp, Rattus norvegicus
ttttcctttcagtatattttccaga

SEQ ID NO: 697073 - DNA, 25 bp, Rattus norvegicus
ttttccttttcacaatgcactttgc

SEQ ID NO: 697074 - DNA, 25 bp, Rattus norvegicus
ttttccttttcagaatgcactttgc

SEQ ID NO: 697075 - DNA, 25 bp, Rattus norvegicus
ttttccttttctatatatctctttg

SEQ ID NO: 697076 - DNA, 25 bp, Rattus norvegicus
ttttccttttctttatatctctttg

SEQ ID NO: 697077 - DNA, 25 bp, Rattus norvegicus
ttttcgaactttatgacagctgacc

SEQ ID NO: 697078 - DNA, 25 bp, Rattus norvegicus
ttttcgaactttttgacagctgacc

SEQ ID NO: 697079 - DNA, 25 bp, Rattus norvegicus
ttttcgagatcaacgagaccccgtg

SEQ ID NO: 697080 - DNA, 25 bp, Rattus norvegicus
ttttcgagatcatcgagaccccgtg

SEQ ID NO: 697081 - DNA, 25 bp, Rattus norvegicus
ttttcgattacaaccagtggcgcta

SEQ ID NO: 697082 - DNA, 25 bp, Rattus norvegicus
ttttcgattacatccagtggcgcta

SEQ ID NO: 697083 - DNA, 25 bp, Rattus norvegicus
ttttcgcagttaagcactgccctat

SEQ ID NO: 697084 - DNA, 25 bp, Rattus norvegicus
ttttcgcagttatgcactgccctat

SEQ ID NO: 697085 - DNA, 25 bp, Rattus norvegicus
ttttcgcccaaaccctgaggttcta

SEQ ID NO: 697086 - DNA, 25 bp, Rattus norvegicus
ttttcgcccaaagcctgaggttcta

SEQ ID NO: 697087 - DNA, 25 bp, Rattus norvegicus
ttttcgctttctattgatgcccagc

SEQ ID NO: 697088 - DNA, 25 bp, Rattus norvegicus
ttttcgctttcttttgatgcccagc

SEQ ID NO: 697089 - DNA, 25 bp, Rattus norvegicus
ttttcggagccaagcttacatcctg

SEQ ID NO: 697090 - DNA, 25 bp, Rattus norvegicus
ttttcggagccatgcttacatcctg

SEQ ID NO: 697091 - DNA, 25 bp, Rattus norvegicus
ttttcggatttcagctggcctacta

SEQ ID NO: 697092 - DNA, 25 bp, Rattus norvegicus
ttttcggatttctgctggcctacta

SEQ ID NO: 697093 - DNA, 25 bp, Rattus norvegicus
ttttcggcagccatccagttcaata

SEQ ID NO: 697094 - DNA, 25 bp, Rattus norvegicus
ttttcggcagccttccagttcaata

SEQ ID NO: 697095 - DNA, 25 bp, Rattus norvegicus
ttttcgggcggaactgctcggcttt

SEQ ID NO: 697096 - DNA, 25 bp, Rattus norvegicus
ttttcgggcggatctgctcggcttt

SEQ ID NO: 697097 - DNA, 25 bp, Rattus norvegicus
ttttcggtaatcacagcactgcgcg

SEQ ID NO: 697098 - DNA, 25 bp, Rattus norvegicus
ttttcggtaatctcagcactgcgcg

SEQ ID NO: 697099 - DNA, 25 bp, Rattus norvegicus
ttttcggtcaggcacaggactcagt

SEQ ID NO: 697100 - DNA, 25 bp, Rattus norvegicus
ttttcggtcagggacaggactcagt

SEQ ID NO: 697101 - DNA, 25 bp, Rattus norvegicus
ttttcgtaagatcgtacaaccttct

SEQ ID NO: 697102 - DNA, 25 bp, Rattus norvegicus
ttttcgtaagatggtacaaccttct

SEQ ID NO: 697103 - DNA, 25 bp, Rattus norvegicus
ttttcgtatcatcttaattcctctg

SEQ ID NO: 697104 - DNA, 25 bp, Rattus norvegicus
ttttcgtatcatgttaattcctctg

SEQ ID NO: 697105 - DNA, 25 bp, Rattus norvegicus
ttttcgtgttgtctctgtcctaaga

SEQ ID NO: 697106 - DNA, 25 bp, Rattus norvegicus
ttttcgtgttgtgtctgtcctaaga

SEQ ID NO: 697107 - DNA, 25 bp, Rattus norvegicus
ttttcgttcgtcactttagacactt

SEQ ID NO: 697108 - DNA, 25 bp, Rattus norvegicus
ttttcgttcgtctctttagacactt

SEQ ID NO: 697109 - DNA, 25 bp, Rattus norvegicus
ttttcgtttgttagagatgcagatt

SEQ ID NO: 697110 - DNA, 25 bp, Rattus norvegicus
ttttcgtttgtttgagatgcagatt

SEQ ID NO: 697111 - DNA, 25 bp, Rattus norvegicus
ttttctaaatctacctgtaaggctc

SEQ ID NO: 697112 - DNA, 25 bp, Rattus norvegicus
ttttctaaatcttcctgtaaggctc

SEQ ID NO: 697113 - DNA, 25 bp, Rattus norvegicus
ttttctaacctccatagactccaag

SEQ ID NO: 697114 - DNA, 25 bp, Rattus norvegicus
ttttctaacctcgatagactccaag

SEQ ID NO: 697115 - DNA, 25 bp, Rattus norvegicus
ttttctaacgccaggactgcactgg

SEQ ID NO: 697116 - DNA, 25 bp, Rattus norvegicus
ttttctaacgcctggactgcactgg

SEQ ID NO: 697117 - DNA, 25 bp, Rattus norvegicus
ttttctaacgtgaggcttttctgta

SEQ ID NO: 697118 - DNA, 25 bp, Rattus norvegicus
ttttctaacgtgtggcttttctgta

SEQ ID NO: 697119 - DNA, 25 bp, Rattus norvegicus
ttttctaactctactgtcccaagaa

SEQ ID NO: 697120 - DNA, 25 bp, Rattus norvegicus
ttttctaactcttctgtcccaagaa

SEQ ID NO: 697121 - DNA, 25 bp, Rattus norvegicus
ttttctacaataaatggcacctgca

SEQ ID NO: 697122 - DNA, 25 bp, Rattus norvegicus
ttttctacaatatatggcacctgca

SEQ ID NO: 697123 - DNA, 25 bp, Rattus norvegicus
ttttctacacatctgagctgagccc

SEQ ID NO: 697124 - DNA, 25 bp, Rattus norvegicus
ttttctacacatgtgagctgagccc

SEQ ID NO: 697125 - DNA, 25 bp, Rattus norvegicus
ttttctacagaaagcacaagtcaag

SEQ ID NO: 697126 - DNA, 25 bp, Rattus norvegicus
ttttctacagaatgcacaagtcaag

SEQ ID NO: 697127 - DNA, 25 bp, Rattus norvegicus
ttttctacagttccctgacacgcag

SEQ ID NO: 697128 - DNA, 25 bp, Rattus norvegicus
ttttctacagttgcctgacacgcag

SEQ ID NO: 697129 - DNA, 25 bp, Rattus norvegicus
ttttctaccaagatctcaagtgcat

SEQ ID NO: 697130 - DNA, 25 bp, Rattus norvegicus
ttttctaccaagttctcaagtgcat

SEQ ID NO: 697131 - DNA, 25 bp, Rattus norvegicus
ttttctaccgaaaagcatcatggat

SEQ ID NO: 697132 - DNA, 25 bp, Rattus norvegicus
ttttctaccgaatagcatcatggat

SEQ ID NO: 697133 - DNA, 25 bp, Rattus norvegicus
ttttctacctaccattcaactgttg

SEQ ID NO: 697134 - DNA, 25 bp, Rattus norvegicus
ttttctacctacgattcaactgttg

SEQ ID NO: 697135 - DNA, 25 bp, Rattus norvegicus
ttttctaccttgactgcattttaaa

SEQ ID NO: 697136 - DNA, 25 bp, Rattus norvegicus
ttttctaccttgcttaccagctccg

SEQ ID NO: 697137 - DNA, 25 bp, Rattus norvegicus
ttttctaccttggttaccagctccg

SEQ ID NO: 697138 - DNA, 25 bp, Rattus norvegicus
ttttctaccttgtctgcattttaaa

SEQ ID NO: 697139 - DNA, 25 bp, Rattus norvegicus
ttttctacctttcctaatacgtgcg

SEQ ID NO: 697140 - DNA, 25 bp, Rattus norvegicus
ttttctacctttgctaatacgtgcg

SEQ ID NO: 697141 - DNA, 25 bp, Rattus norvegicus
ttttctacgctcatctgctattgaa

SEQ ID NO: 697142 - DNA, 25 bp, Rattus norvegicus
ttttctacgctcttctgctattgaa

SEQ ID NO: 697143 - DNA, 25 bp, Rattus norvegicus
ttttctactgttactgatacgcatg

SEQ ID NO: 697144 - DNA, 25 bp, Rattus norvegicus
ttttctactgtttctgatacgcatg

SEQ ID NO: 697145 - DNA, 25 bp, Rattus norvegicus
ttttctactttccactttcctatat

SEQ ID NO: 697146 - DNA, 25 bp, Rattus norvegicus
ttttctactttcgactttcctatat

SEQ ID NO: 697147 - DNA, 25 bp, Rattus norvegicus
ttttctagaagtaccgttccaagtg

SEQ ID NO: 697148 - DNA, 25 bp, Rattus norvegicus
ttttctagaagttccgttccaagtg

SEQ ID NO: 697149 - DNA, 25 bp, Rattus norvegicus
ttttctagattaatccagccagcct

SEQ ID NO: 697150 - DNA, 25 bp, Rattus norvegicus
ttttctagattattccagccagcct

SEQ ID NO: 697151 - DNA, 25 bp, Rattus norvegicus
ttttctagcccacaagtcatcctta

SEQ ID NO: 697152 - DNA, 25 bp, Rattus norvegicus
ttttctagcccagaagtcatcctta

SEQ ID NO: 697153 - DNA, 25 bp, Rattus norvegicus
ttttctataaagcatgtaactgaca

SEQ ID NO: 697154 - DNA, 25 bp, Rattus norvegicus
ttttctataaaggatgtaactgaca

SEQ ID NO: 697155 - DNA, 25 bp, Rattus norvegicus
ttttctatatagatccttgccttaa

SEQ ID NO: 697156 - DNA, 25 bp, Rattus norvegicus
ttttctatatagttccttgccttaa

SEQ ID NO: 697157 - DNA, 25 bp, Rattus norvegicus
ttttctatctagagctctgttgagc

SEQ ID NO: 697158 - DNA, 25 bp, Rattus norvegicus
ttttctatctagtgctctgttgagc

SEQ ID NO: 697159 - DNA, 25 bp, Rattus norvegicus
ttttctatctgtaggacctggccac

SEQ ID NO: 697160 - DNA, 25 bp, Rattus norvegicus
ttttctatctgttggacctggccac

SEQ ID NO: 697161 - DNA, 25 bp, Rattus norvegicus
ttttctatgctaactcttgtttgtt

SEQ ID NO: 697162 - DNA, 25 bp, Rattus norvegicus
ttttctatgctatctcttgtttgtt

SEQ ID NO: 697163 - DNA, 25 bp, Rattus norvegicus
ttttctattgtaccctcagcactta

SEQ ID NO: 697164 - DNA, 25 bp, Rattus norvegicus
ttttctattgtagcctcagcactta

SEQ ID NO: 697165 - DNA, 25 bp, Rattus norvegicus
ttttctattgttacactgcttcctc

SEQ ID NO: 697166 - DNA, 25 bp, Rattus norvegicus
ttttctattgtttcactgcttcctc

SEQ ID NO: 697167 - DNA, 25 bp, Rattus norvegicus
ttttctatttggacatggtttaatc

SEQ ID NO: 697168 - DNA, 25 bp, Rattus norvegicus
ttttctatttggtcatggtttaatc

SEQ ID NO: 697169 - DNA, 25 bp, Rattus norvegicus
ttttctcaaaaaccctgctcaacag

SEQ ID NO: 697170 - DNA, 25 bp, Rattus norvegicus
ttttctcaaaaagcctgctcaacag

SEQ ID NO: 697171 - DNA, 25 bp, Rattus norvegicus
ttttctcaaacacaacgctacctct

SEQ ID NO: 697172 - DNA, 25 bp, Rattus norvegicus
ttttctcaaacagaacgctacctct

SEQ ID NO: 697173 - DNA, 25 bp, Rattus norvegicus
ttttctcaaagaaagctcggctagc

SEQ ID NO: 697174 - DNA, 25 bp, Rattus norvegicus
ttttctcaaagatagctcggctagc

SEQ ID NO: 697175 - DNA, 25 bp, Rattus norvegicus
ttttctcaacatatggcttgccaca

SEQ ID NO: 697176 - DNA, 25 bp, Rattus norvegicus
ttttctcaacatttggcttgccaca

SEQ ID NO: 697177 - DNA, 25 bp, Rattus norvegicus
ttttctcaaggaagactctcatcgg

SEQ ID NO: 697178 - DNA, 25 bp, Rattus norvegicus
ttttctcaaggatgactctcatcgg

SEQ ID NO: 697179 - DNA, 25 bp, Rattus norvegicus
ttttctcaatgcctccagaaaccca

SEQ ID NO: 697180 - DNA, 25 bp, Rattus norvegicus
ttttctcaatgcgtccagaaaccca

SEQ ID NO: 697181 - DNA, 25 bp, Rattus norvegicus
ttttctcacgcgaatacatgcctat

SEQ ID NO: 697182 - DNA, 25 bp, Rattus norvegicus
ttttctcacgcgtatacatgcctat

SEQ ID NO: 697183 - DNA, 25 bp, Rattus norvegicus
ttttctcagaatacttgggcttaca

SEQ ID NO: 697184 - DNA, 25 bp, Rattus norvegicus
ttttctcagaatcgctaaggcgact

SEQ ID NO: 697185 - DNA, 25 bp, Rattus norvegicus
ttttctcagaatggctaaggcgact

SEQ ID NO: 697186 - DNA, 25 bp, Rattus norvegicus
ttttctcagaattcttgggcttaca

SEQ ID NO: 697187 - DNA, 25 bp, Rattus norvegicus
ttttctcagagccttccgtatgctg

SEQ ID NO: 697188 - DNA, 25 bp, Rattus norvegicus
ttttctcagagcgttccgtatgctg

SEQ ID NO: 697189 - DNA, 25 bp, Rattus norvegicus
ttttctcagcaaaggcccatcaagc

SEQ ID NO: 697190 - DNA, 25 bp, Rattus norvegicus
ttttctcagcaatggcccatcaagc

SEQ ID NO: 697191 - DNA, 25 bp, Rattus norvegicus
ttttctcagcagaggtttcgggtga

SEQ ID NO: 697192 - DNA, 25 bp, Rattus norvegicus
ttttctcagcagtggtttcgggtga

SEQ ID NO: 697193 - DNA, 25 bp, Rattus norvegicus
ttttctcaggagattcaacgatttc

SEQ ID NO: 697194 - DNA, 25 bp, Rattus norvegicus
ttttctcaggagtttcaacgatttc

SEQ ID NO: 697195 - DNA, 25 bp, Rattus norvegicus
ttttctcaggctcgagactgcagct

SEQ ID NO: 697196 - DNA, 25 bp, Rattus norvegicus
ttttctcaggctggagactgcagct

SEQ ID NO: 697197 - DNA, 25 bp, Rattus norvegicus
ttttctcagtcgattttccctatat

SEQ ID NO: 697198 - DNA, 25 bp, Rattus norvegicus
ttttctcagtcgtttttccctatat

SEQ ID NO: 697199 - DNA, 25 bp, Rattus norvegicus
ttttctcatcccagtcagttgactg

SEQ ID NO: 697200 - DNA, 25 bp, Rattus norvegicus
ttttctcatccctgtcagttgactg

SEQ ID NO: 697201 - DNA, 25 bp, Rattus norvegicus
ttttctccaaccaggtaaccaaatg

SEQ ID NO: 697202 - DNA, 25 bp, Rattus norvegicus
ttttctccaacctggtaaccaaatg

SEQ ID NO: 697203 - DNA, 25 bp, Rattus norvegicus
ttttctccactgcttgaaggcctca

SEQ ID NO: 697204 - DNA, 25 bp, Rattus norvegicus
ttttctccactggttgaaggcctca

SEQ ID NO: 697205 - DNA, 25 bp, Rattus norvegicus
ttttctccagtcagttgttgctgag

SEQ ID NO: 697206 - DNA, 25 bp, Rattus norvegicus
ttttctccagtctgttgttgctgag

SEQ ID NO: 697207 - DNA, 25 bp, Rattus norvegicus
ttttctccagtgcagtctactttgc

SEQ ID NO: 697208 - DNA, 25 bp, Rattus norvegicus
ttttctccagtggagtctactttgc

SEQ ID NO: 697209 - DNA, 25 bp, Rattus norvegicus
ttttctccatctcgacattaataaa

SEQ ID NO: 697210 - DNA, 25 bp, Rattus norvegicus
ttttctccatctggacattaataaa

SEQ ID NO: 697211 - DNA, 25 bp, Rattus norvegicus
ttttctccatgacaccgaggactgg

SEQ ID NO: 697212 - DNA, 25 bp, Rattus norvegicus
ttttctccatgagaccgaggactgg

SEQ ID NO: 697213 - DNA, 25 bp, Rattus norvegicus
ttttctccatgtatgaccagactca

SEQ ID NO: 697214 - DNA, 25 bp, Rattus norvegicus
ttttctccatgtttgaccagactca

SEQ ID NO: 697215 - DNA, 25 bp, Rattus norvegicus
ttttctcccatgacttatgtggttt

SEQ ID NO: 697216 - DNA, 25 bp, Rattus norvegicus
ttttctcccatgataactgatctgt

SEQ ID NO: 697217 - DNA, 25 bp, Rattus norvegicus
ttttctcccatgtcttatgtggttt

SEQ ID NO: 697218 - DNA, 25 bp, Rattus norvegicus
ttttctcccatgttaactgatctgt

SEQ ID NO: 697219 - DNA, 25 bp, Rattus norvegicus
ttttctccccagatgtttttgagga

SEQ ID NO: 697220 - DNA, 25 bp, Rattus norvegicus
ttttctccccagttgtttttgagga

SEQ ID NO: 697221 - DNA, 25 bp, Rattus norvegicus
ttttctcccctgaaattgtgtctgg

SEQ ID NO: 697222 - DNA, 25 bp, Rattus norvegicus
ttttctcccctgtaattgtgtctgg

SEQ ID NO: 697223 - DNA, 25 bp, Rattus norvegicus
ttttctcccgccatttgtattgata

SEQ ID NO: 697224 - DNA, 25 bp, Rattus norvegicus
ttttctcccgccttttgtattgata

SEQ ID NO: 697225 - DNA, 25 bp, Rattus norvegicus
ttttctcccgggacaagaggcgcct

SEQ ID NO: 697226 - DNA, 25 bp, Rattus norvegicus
ttttctcccgggtcaagaggcgcct

SEQ ID NO: 697227 - DNA, 25 bp, Rattus norvegicus
ttttctccggtactgcaggttttga

SEQ ID NO: 697228 - DNA, 25 bp, Rattus norvegicus
ttttctccggtagtgcaggttttga

SEQ ID NO: 697229 - DNA, 25 bp, Rattus norvegicus
ttttctccggttcccacctgattac

SEQ ID NO: 697230 - DNA, 25 bp, Rattus norvegicus
ttttctccggttgccacctgattac

SEQ ID NO: 697231 - DNA, 25 bp, Rattus norvegicus
ttttctcctatgactatgttgttat

SEQ ID NO: 697232 - DNA, 25 bp, Rattus norvegicus
ttttctcctatgtctatgttgttat

SEQ ID NO: 697233 - DNA, 25 bp, Rattus norvegicus
ttttctcctcacatttctggtttag

SEQ ID NO: 697234 - DNA, 25 bp, Rattus norvegicus
ttttctcctcacttttctggtttag

SEQ ID NO: 697235 - DNA, 25 bp, Rattus norvegicus
ttttctcctgaaatcgacgcacagc

SEQ ID NO: 697236 - DNA, 25 bp, Rattus norvegicus
ttttctcctgaattcgacgcacagc

SEQ ID NO: 697237 - DNA, 25 bp, Rattus norvegicus
ttttctcctgatagctcctgtgtaa

SEQ ID NO: 697238 - DNA, 25 bp, Rattus norvegicus
ttttctcctgattgctcctgtgtaa

SEQ ID NO: 697239 - DNA, 25 bp, Rattus norvegicus
ttttctcctgcaatgaaacagtttg

SEQ ID NO: 697240 - DNA, 25 bp, Rattus norvegicus
ttttctcctgcattgaaacagtttg

SEQ ID NO: 697241 - DNA, 25 bp, Rattus norvegicus
ttttctcctttgctgttgaggtaac

SEQ ID NO: 697242 - DNA, 25 bp, Rattus norvegicus
ttttctcctttggtgttgaggtaac

SEQ ID NO: 697243 - DNA, 25 bp, Rattus norvegicus
ttttctccttttcggcctcttcaag

SEQ ID NO: 697244 - DNA, 25 bp, Rattus norvegicus
ttttctccttttgggcctcttcaag

SEQ ID NO: 697245 - DNA, 25 bp, Rattus norvegicus
ttttctcgagtacaacacccaggga

SEQ ID NO: 697246 - DNA, 25 bp, Rattus norvegicus
ttttctcgagtagaacacccaggga

SEQ ID NO: 697247 - DNA, 25 bp, Rattus norvegicus
ttttctcgctatcttgaccggcaga

SEQ ID NO: 697248 - DNA, 25 bp, Rattus norvegicus
ttttctcgctatgttgaccggcaga

SEQ ID NO: 697249 - DNA, 25 bp, Rattus norvegicus
ttttctcgtggacaagggatctctc

SEQ ID NO: 697250 - DNA, 25 bp, Rattus norvegicus
ttttctcgtggagaagggatctctc

SEQ ID NO: 697251 - DNA, 25 bp, Rattus norvegicus
ttttctctaacaacatctgccgtca

SEQ ID NO: 697252 - DNA, 25 bp, Rattus norvegicus
ttttctctaacatcatctgccgtca

SEQ ID NO: 697253 - DNA, 25 bp, Rattus norvegicus
ttttctctacttactgggaacccag

SEQ ID NO: 697254 - DNA, 25 bp, Rattus norvegicus
ttttctctactttctgggaacccag

SEQ ID NO: 697255 - DNA, 25 bp, Rattus norvegicus
ttttctctatttcctcctctgaacc

SEQ ID NO: 697256 - DNA, 25 bp, Rattus norvegicus
ttttctctatttgctcctctgaacc

SEQ ID NO: 697257 - DNA, 25 bp, Rattus norvegicus
ttttctctcaccactatttcattgt

SEQ ID NO: 697258 - DNA, 25 bp, Rattus norvegicus
ttttctctcacctctatttcattgt

SEQ ID NO: 697259 - DNA, 25 bp, Rattus norvegicus
ttttctctcataaatggcacctggg

SEQ ID NO: 697260 - DNA, 25 bp, Rattus norvegicus
ttttctctcatatatggcacctggg

SEQ ID NO: 697261 - DNA, 25 bp, Rattus norvegicus
ttttctctcccaacatgtaactttc

SEQ ID NO: 697262 - DNA, 25 bp, Rattus norvegicus
ttttctctcccacctggaagacgga

SEQ ID NO: 697263 - DNA, 25 bp, Rattus norvegicus
ttttctctcccagctggaagacgga

SEQ ID NO: 697264 - DNA, 25 bp, Rattus norvegicus
ttttctctcccatcatgtaactttc

SEQ ID NO: 697265 - DNA, 25 bp, Rattus norvegicus
ttttctctcctgaagttctgggaac

SEQ ID NO: 697266 - DNA, 25 bp, Rattus norvegicus
ttttctctcctgtagttctgggaac

SEQ ID NO: 697267 - DNA, 25 bp, Rattus norvegicus
ttttctctctccctgtgtgtgtcat

SEQ ID NO: 697268 - DNA, 25 bp, Rattus norvegicus
ttttctctctccgtgtgtgtgtcat

SEQ ID NO: 697269 - DNA, 25 bp, Rattus norvegicus
ttttctctctgcaacagtgtgtgct

SEQ ID NO: 697270 - DNA, 25 bp, Rattus norvegicus
ttttctctctgccaactttcagtat

SEQ ID NO: 697271 - DNA, 25 bp, Rattus norvegicus
ttttctctctgcgaactttcagtat

SEQ ID NO: 697272 - DNA, 25 bp, Rattus norvegicus
ttttctctctgctacagtgtgtgct

SEQ ID NO: 697273 - DNA, 25 bp, Rattus norvegicus
ttttctctcttaaatttatgaccag

SEQ ID NO: 697274 - DNA, 25 bp, Rattus norvegicus
ttttctctcttatatttatgaccag

SEQ ID NO: 697275 - DNA, 25 bp, Rattus norvegicus
ttttctctctttctctgctgccttt

SEQ ID NO: 697276 - DNA, 25 bp, Rattus norvegicus
ttttctctctttgtctgctgccttt

SEQ ID NO: 697277 - DNA, 25 bp, Rattus norvegicus
ttttctctgaccatttccatccttg

SEQ ID NO: 697278 - DNA, 25 bp, Rattus norvegicus
ttttctctgaccttttccatccttg

SEQ ID NO: 697279 - DNA, 25 bp, Rattus norvegicus
ttttctctgattaagtggtttgcat

SEQ ID NO: 697280 - DNA, 25 bp, Rattus norvegicus
ttttctctgatttagtggtttgcat

SEQ ID NO: 697281 - DNA, 25 bp, Rattus norvegicus
ttttctctggatacaactaccatgt

SEQ ID NO: 697282 - DNA, 25 bp, Rattus norvegicus
ttttctctggattcaactaccatgt

SEQ ID NO: 697283 - DNA, 25 bp, Rattus norvegicus
ttttctctgggtccaaagatgttca

SEQ ID NO: 697284 - DNA, 25 bp, Rattus norvegicus
ttttctctgggtgcaaagatgttca

SEQ ID NO: 697285 - DNA, 25 bp, Rattus norvegicus
ttttctctgttgctgctgtgttaaa

SEQ ID NO: 697286 - DNA, 25 bp, Rattus norvegicus
ttttctctgttgcttctggccaaga

SEQ ID NO: 697287 - DNA, 25 bp, Rattus norvegicus
ttttctctgttggtgctgtgttaaa

SEQ ID NO: 697288 - DNA, 25 bp, Rattus norvegicus
ttttctctgttggttctggccaaga

SEQ ID NO: 697289 - DNA, 25 bp, Rattus norvegicus
ttttctcttcagagcatgacctcca

SEQ ID NO: 697290 - DNA, 25 bp, Rattus norvegicus
ttttctcttcagtgcatgacctcca

SEQ ID NO: 697291 - DNA, 25 bp, Rattus norvegicus
ttttctcttgcaagctttacctatc

SEQ ID NO: 697292 - DNA, 25 bp, Rattus norvegicus
ttttctcttgcatgctttacctatc

SEQ ID NO: 697293 - DNA, 25 bp, Rattus norvegicus
ttttctcttgctactgggacctagt

SEQ ID NO: 697294 - DNA, 25 bp, Rattus norvegicus
ttttctcttgcttctgggacctagt

SEQ ID NO: 697295 - DNA, 25 bp, Rattus norvegicus
ttttctcttggcaggtcaagtgtta

SEQ ID NO: 697296 - DNA, 25 bp, Rattus norvegicus
ttttctcttggctggtcaagtgtta

SEQ ID NO: 697297 - DNA, 25 bp, Rattus norvegicus
ttttctctttctctgcatggatttc

SEQ ID NO: 697298 - DNA, 25 bp, Rattus norvegicus
ttttctctttctgtgcatggatttc

SEQ ID NO: 697299 - DNA, 25 bp, Rattus norvegicus
ttttctctttgcaggttgtatgtac

SEQ ID NO: 697300 - DNA, 25 bp, Rattus norvegicus
ttttctctttgcatgctatgatagc

SEQ ID NO: 697301 - DNA, 25 bp, Rattus norvegicus
ttttctctttgctggttgtatgtac

SEQ ID NO: 697302 - DNA, 25 bp, Rattus norvegicus
ttttctctttgcttgctatgatagc

SEQ ID NO: 697303 - DNA, 25 bp, Rattus norvegicus
ttttctctttggattctccaataat

SEQ ID NO: 697304 - DNA, 25 bp, Rattus norvegicus
ttttctctttggtttctccaataat

SEQ ID NO: 697305 - DNA, 25 bp, Rattus norvegicus
ttttctgaatttcccaggttctggt

SEQ ID NO: 697306 - DNA, 25 bp, Rattus norvegicus
ttttctgaatttgccaggttctggt

SEQ ID NO: 697307 - DNA, 25 bp, Rattus norvegicus
ttttctgaccacataaaggcttctt

SEQ ID NO: 697308 - DNA, 25 bp, Rattus norvegicus
ttttctgaccacttaaaggcttctt

SEQ ID NO: 697309 - DNA, 25 bp, Rattus norvegicus
ttttctgacctcattagggtgggat

SEQ ID NO: 697310 - DNA, 25 bp, Rattus norvegicus
ttttctgacctctttagggtgggat

SEQ ID NO: 697311 - DNA, 25 bp, Rattus norvegicus
ttttctgacttcaagtgagccagtt

SEQ ID NO: 697312 - DNA, 25 bp, Rattus norvegicus
ttttctgacttctagtgagccagtt

SEQ ID NO: 697313 - DNA, 25 bp, Rattus norvegicus
ttttctgacttgaacactctcctgc

SEQ ID NO: 697314 - DNA, 25 bp, Rattus norvegicus
ttttctgacttgtacactctcctgc

SEQ ID NO: 697315 - DNA, 25 bp, Rattus norvegicus
ttttctgatatgatgtccgactgtt

SEQ ID NO: 697316 - DNA, 25 bp, Rattus norvegicus
ttttctgatatgttgtccgactgtt

SEQ ID NO: 697317 - DNA, 25 bp, Rattus norvegicus
ttttctgatcccaatggacaccggg

SEQ ID NO: 697318 - DNA, 25 bp, Rattus norvegicus
ttttctgatccctatggacaccggg

SEQ ID NO: 697319 - DNA, 25 bp, Rattus norvegicus
ttttctgatgtcacagctggcctca

SEQ ID NO: 697320 - DNA, 25 bp, Rattus norvegicus
ttttctgatgtctcagctggcctca

SEQ ID NO: 697321 - DNA, 25 bp, Rattus norvegicus
ttttctgattaactttggcctctct

SEQ ID NO: 697322 - DNA, 25 bp, Rattus norvegicus
ttttctgattaagtttggcctctct

SEQ ID NO: 697323 - DNA, 25 bp, Rattus norvegicus
ttttctgcacgtctattagcttttg

SEQ ID NO: 697324 - DNA, 25 bp, Rattus norvegicus
ttttctgcacgtgtattagcttttg

SEQ ID NO: 697325 - DNA, 25 bp, Rattus norvegicus
ttttctgcaggaacccgaatggtgc

SEQ ID NO: 697326 - DNA, 25 bp, Rattus norvegicus
ttttctgcaggatcccgaatggtgc

SEQ ID NO: 697327 - DNA, 25 bp, Rattus norvegicus
ttttctgcagggattagcatccggt

SEQ ID NO: 697328 - DNA, 25 bp, Rattus norvegicus
ttttctgcagggtttagcatccggt

SEQ ID NO: 697329 - DNA, 25 bp, Rattus norvegicus
ttttctgcatatagagcctcagtca

SEQ ID NO: 697330 - DNA, 25 bp, Rattus norvegicus
ttttctgcatattgagcctcagtca

SEQ ID NO: 697331 - DNA, 25 bp, Rattus norvegicus
ttttctgcattcagagtctcttcct

SEQ ID NO: 697332 - DNA, 25 bp, Rattus norvegicus
ttttctgcattctgagtctcttcct

SEQ ID NO: 697333 - DNA, 25 bp, Rattus norvegicus
ttttctgccagcctgcacgtggacc

SEQ ID NO: 697334 - DNA, 25 bp, Rattus norvegicus
ttttctgccagcgtgcacgtggacc

SEQ ID NO: 697335 - DNA, 25 bp, Rattus norvegicus
ttttctgccattatggtctactcac

SEQ ID NO: 697336 - DNA, 25 bp, Rattus norvegicus
ttttctgccattttggtctactcac

SEQ ID NO: 697337 - DNA, 25 bp, Rattus norvegicus
ttttctgccggtcttgttctgcaaa

SEQ ID NO: 697338 - DNA, 25 bp, Rattus norvegicus
ttttctgccggtgttgttctgcaaa

SEQ ID NO: 697339 - DNA, 25 bp, Rattus norvegicus
ttttctgcctagatctgtgatttca

SEQ ID NO: 697340 - DNA, 25 bp, Rattus norvegicus
ttttctgcctagttctgtgatttca

SEQ ID NO: 697341 - DNA, 25 bp, Rattus norvegicus
ttttctgcgtcaagcatgtgtgctc

SEQ ID NO: 697342 - DNA, 25 bp, Rattus norvegicus
ttttctgcgtcatgcatgtgtgctc

SEQ ID NO: 697343 - DNA, 25 bp, Rattus norvegicus
ttttctgctaatacaggtcctgcac

SEQ ID NO: 697344 - DNA, 25 bp, Rattus norvegicus
ttttctgctaattcaggtcctgcac

SEQ ID NO: 697345 - DNA, 25 bp, Rattus norvegicus
ttttctgctgacacacttgttgcta

SEQ ID NO: 697346 - DNA, 25 bp, Rattus norvegicus
ttttctgctgactcacttgttgcta

SEQ ID NO: 697347 - DNA, 25 bp, Rattus norvegicus
ttttctgctgcccttcagagttggt

SEQ ID NO: 697348 - DNA, 25 bp, Rattus norvegicus
ttttctgctgccgttcagagttggt

SEQ ID NO: 697349 - DNA, 25 bp, Rattus norvegicus
ttttctgcttacctcactcacaaat

SEQ ID NO: 697350 - DNA, 25 bp, Rattus norvegicus
ttttctgcttacgtcactcacaaat

SEQ ID NO: 697351 - DNA, 25 bp, Rattus norvegicus
ttttctgcttctatcatagggcatt

SEQ ID NO: 697352 - DNA, 25 bp, Rattus norvegicus
ttttctgcttctttcatagggcatt

SEQ ID NO: 697353 - DNA, 25 bp, Rattus norvegicus
ttttctggacaaacctgagccctaa

SEQ ID NO: 697354 - DNA, 25 bp, Rattus norvegicus
ttttctggacaatcctgagccctaa

SEQ ID NO: 697355 - DNA, 25 bp, Rattus norvegicus
ttttctggacatcaactgcacctca

SEQ ID NO: 697356 - DNA, 25 bp, Rattus norvegicus
ttttctggacatgaactgcacctca

SEQ ID NO: 697357 - DNA, 25 bp, Rattus norvegicus
ttttctggagacatttaataccttt

SEQ ID NO: 697358 - DNA, 25 bp, Rattus norvegicus
ttttctggagacttttaataccttt

SEQ ID NO: 697359 - DNA, 25 bp, Rattus norvegicus
ttttctggagtaagatcgccctgga

SEQ ID NO: 697360 - DNA, 25 bp, Rattus norvegicus
ttttctggagtatgatcgccctgga

SEQ ID NO: 697361 - DNA, 25 bp, Rattus norvegicus
ttttctggcatcagatctgctcaag

SEQ ID NO: 697362 - DNA, 25 bp, Rattus norvegicus
ttttctggcatctgatctgctcaag

SEQ ID NO: 697363 - DNA, 25 bp, Rattus norvegicus
ttttctggctcccataggcactgca

SEQ ID NO: 697364 - DNA, 25 bp, Rattus norvegicus
ttttctggctccgataggcactgca

SEQ ID NO: 697365 - DNA, 25 bp, Rattus norvegicus
ttttctggctgtcatgtgcaatggt

SEQ ID NO: 697366 - DNA, 25 bp, Rattus norvegicus
ttttctggctgtgatgtgcaatggt

SEQ ID NO: 697367 - DNA, 25 bp, Rattus norvegicus
ttttctggctttcatgtatgtccct

SEQ ID NO: 697368 - DNA, 25 bp, Rattus norvegicus
ttttctggctttgatgtatgtccct

SEQ ID NO: 697369 - DNA, 25 bp, Rattus norvegicus
ttttctgggaaaagacgacttttat

SEQ ID NO: 697370 - DNA, 25 bp, Rattus norvegicus
ttttctgggaaatgacgacttttat

SEQ ID NO: 697371 - DNA, 25 bp, Rattus norvegicus
ttttctgggaacacccataggccct

SEQ ID NO: 697372 - DNA, 25 bp, Rattus norvegicus
ttttctgggaactcccataggccct

SEQ ID NO: 697373 - DNA, 25 bp, Rattus norvegicus
ttttctgggataaagccccagcctt

SEQ ID NO: 697374 - DNA, 25 bp, Rattus norvegicus
ttttctgggatatagccccagcctt

SEQ ID NO: 697375 - DNA, 25 bp, Rattus norvegicus
ttttctgggcatcagaccttacttt

SEQ ID NO: 697376 - DNA, 25 bp, Rattus norvegicus
ttttctgggcatgagaccttacttt

SEQ ID NO: 697377 - DNA, 25 bp, Rattus norvegicus
ttttctggtgctcttgacctgcaga

SEQ ID NO: 697378 - DNA, 25 bp, Rattus norvegicus
ttttctggtgctgttgacctgcaga

SEQ ID NO: 697379 - DNA, 25 bp, Rattus norvegicus
ttttctgtaaaactgcccattccgc

SEQ ID NO: 697380 - DNA, 25 bp, Rattus norvegicus
ttttctgtaaaagtgcccattccgc

SEQ ID NO: 697381 - DNA, 25 bp, Rattus norvegicus
ttttctgtaaccatttgcaatctag

SEQ ID NO: 697382 - DNA, 25 bp, Rattus norvegicus
ttttctgtaaccttttgcaatctag

SEQ ID NO: 697383 - DNA, 25 bp, Rattus norvegicus
ttttctgtaaggaataattcatggg

SEQ ID NO: 697384 - DNA, 25 bp, Rattus norvegicus
ttttctgtaaggtataattcatggg

SEQ ID NO: 697385 - DNA, 25 bp, Rattus norvegicus
ttttctgtaccaatctaggccagga

SEQ ID NO: 697386 - DNA, 25 bp, Rattus norvegicus
ttttctgtaccattctaggccagga

SEQ ID NO: 697387 - DNA, 25 bp, Rattus norvegicus
ttttctgtaggtagcttatttattc

SEQ ID NO: 697388 - DNA, 25 bp, Rattus norvegicus
ttttctgtaggttgcttatttattc

SEQ ID NO: 697389 - DNA, 25 bp, Rattus norvegicus
ttttctgtagtccttgacggtgacg

SEQ ID NO: 697390 - DNA, 25 bp, Rattus norvegicus
ttttctgtagtcgttgacggtgacg

SEQ ID NO: 697391 - DNA, 25 bp, Rattus norvegicus
ttttctgtatataggcctctagtgc

SEQ ID NO: 697392 - DNA, 25 bp, Rattus norvegicus
ttttctgtatattggcctctagtgc

SEQ ID NO: 697393 - DNA, 25 bp, Rattus norvegicus
ttttctgtattaattgcgtccccaa

SEQ ID NO: 697394 - DNA, 25 bp, Rattus norvegicus
ttttctgtattatttgcgtccccaa

SEQ ID NO: 697395 - DNA, 25 bp, Rattus norvegicus
ttttctgtattcctcacatctgtgc

SEQ ID NO: 697396 - DNA, 25 bp, Rattus norvegicus
ttttctgtattcgtcacatctgtgc

SEQ ID NO: 697397 - DNA, 25 bp, Rattus norvegicus
ttttctgtcagaaccatgaggctct

SEQ ID NO: 697398 - DNA, 25 bp, Rattus norvegicus
ttttctgtcagatccatgaggctct

SEQ ID NO: 697399 - DNA, 25 bp, Rattus norvegicus
ttttctgtcagcagcgaggaactct

SEQ ID NO: 697400 - DNA, 25 bp, Rattus norvegicus
ttttctgtcagctgcgaggaactct

SEQ ID NO: 697401 - DNA, 25 bp, Rattus norvegicus
ttttctgtccataatgactgtctag

SEQ ID NO: 697402 - DNA, 25 bp, Rattus norvegicus
ttttctgtccattatgactgtctag

SEQ ID NO: 697403 - DNA, 25 bp, Rattus norvegicus
ttttctgtcccacgagatatgcaaa

SEQ ID NO: 697404 - DNA, 25 bp, Rattus norvegicus
ttttctgtcccaggagatatgcaaa

SEQ ID NO: 697405 - DNA, 25 bp, Rattus norvegicus
ttttctgtctaaagtgacctgtgtt

SEQ ID NO: 697406 - DNA, 25 bp, Rattus norvegicus
ttttctgtctaatgtgacctgtgtt

SEQ ID NO: 697407 - DNA, 25 bp, Rattus norvegicus
ttttctgtgcagatttctccgtcct

SEQ ID NO: 697408 - DNA, 25 bp, Rattus norvegicus
ttttctgtgcagttttctccgtcct

SEQ ID NO: 697409 - DNA, 25 bp, Rattus norvegicus
ttttctgtgcctccataatgctcac

SEQ ID NO: 697410 - DNA, 25 bp, Rattus norvegicus
ttttctgtgcctgcataatgctcac

SEQ ID NO: 697411 - DNA, 25 bp, Rattus norvegicus
ttttctgtgcggcatcagtcacgtt

SEQ ID NO: 697412 - DNA, 25 bp, Rattus norvegicus
ttttctgtgcgggatcagtcacgtt

SEQ ID NO: 697413 - DNA, 25 bp, Rattus norvegicus
ttttctgtgctaatgtgatcttaac

SEQ ID NO: 697414 - DNA, 25 bp, Rattus norvegicus
ttttctgtgctattgtgatcttaac

SEQ ID NO: 697415 - DNA, 25 bp, Rattus norvegicus
ttttctgtgcttagtcatttgactc

SEQ ID NO: 697416 - DNA, 25 bp, Rattus norvegicus
ttttctgtgctttgtcatttgactc

SEQ ID NO: 697417 - DNA, 25 bp, Rattus norvegicus
ttttctgtgggaccattccattcag

SEQ ID NO: 697418 - DNA, 25 bp, Rattus norvegicus
ttttctgtgggagcattccattcag

SEQ ID NO: 697419 - DNA, 25 bp, Rattus norvegicus
ttttctgtgtatcccgagtcattcc

SEQ ID NO: 697420 - DNA, 25 bp, Rattus norvegicus
ttttctgtgtatgccgagtcattcc

SEQ ID NO: 697421 - DNA, 25 bp, Rattus norvegicus
ttttctgtgtgaacctatctccttg

SEQ ID NO: 697422 - DNA, 25 bp, Rattus norvegicus
ttttctgtgtgatcctatctccttg

SEQ ID NO: 697423 - DNA, 25 bp, Rattus norvegicus
ttttctgtgtgtaaccttagtgtca

SEQ ID NO: 697424 - DNA, 25 bp, Rattus norvegicus
ttttctgtgtgttaccttagtgtca

SEQ ID NO: 697425 - DNA, 25 bp, Rattus norvegicus
ttttctgtgttcacctagcctaaag

SEQ ID NO: 697426 - DNA, 25 bp, Rattus norvegicus
ttttctgtgttctcctagcctaaag

SEQ ID NO: 697427 - DNA, 25 bp, Rattus norvegicus
ttttctgttaccactgttccttttg

SEQ ID NO: 697428 - DNA, 25 bp, Rattus norvegicus
ttttctgttacctctgttccttttg

SEQ ID NO: 697429 - DNA, 25 bp, Rattus norvegicus
ttttctgttcctcatttcccctgaa

SEQ ID NO: 697430 - DNA, 25 bp, Rattus norvegicus
ttttctgttcctcggcaatgggagg

SEQ ID NO: 697431 - DNA, 25 bp, Rattus norvegicus
ttttctgttcctgatttcccctgaa

SEQ ID NO: 697432 - DNA, 25 bp, Rattus norvegicus
ttttctgttcctgggcaatgggagg

SEQ ID NO: 697433 - DNA, 25 bp, Rattus norvegicus
ttttctgttcgtccaaactgtcagc

SEQ ID NO: 697434 - DNA, 25 bp, Rattus norvegicus
ttttctgttcgtgcaaactgtcagc

SEQ ID NO: 697435 - DNA, 25 bp, Rattus norvegicus
ttttctgttttgactcttctcactg

SEQ ID NO: 697436 - DNA, 25 bp, Rattus norvegicus
ttttctgttttgatactgggtctcg

SEQ ID NO: 697437 - DNA, 25 bp, Rattus norvegicus
ttttctgttttgtctcttctcactg

SEQ ID NO: 697438 - DNA, 25 bp, Rattus norvegicus
ttttctgttttgttactgggtctcg

SEQ ID NO: 697439 - DNA, 25 bp, Rattus norvegicus
ttttcttacagtcaggtctgccggc

SEQ ID NO: 697440 - DNA, 25 bp, Rattus norvegicus
ttttcttacagtgaggtctgccggc

SEQ ID NO: 697441 - DNA, 25 bp, Rattus norvegicus
ttttcttacatcagtcttgctcgga

SEQ ID NO: 697442 - DNA, 25 bp, Rattus norvegicus
ttttcttacatctgtcttgctcgga

SEQ ID NO: 697443 - DNA, 25 bp, Rattus norvegicus
ttttcttacctaatctttgtcacag

SEQ ID NO: 697444 - DNA, 25 bp, Rattus norvegicus
ttttcttacctattctttgtcacag

SEQ ID NO: 697445 - DNA, 25 bp, Rattus norvegicus
ttttcttaccttatggctctacgat

SEQ ID NO: 697446 - DNA, 25 bp, Rattus norvegicus
ttttcttaccttttggctctacgat

SEQ ID NO: 697447 - DNA, 25 bp, Rattus norvegicus
ttttcttacttaatgtcggcccttg

SEQ ID NO: 697448 - DNA, 25 bp, Rattus norvegicus
ttttcttacttattgtcggcccttg

SEQ ID NO: 697449 - DNA, 25 bp, Rattus norvegicus
ttttcttagcatctcagggtgggca

SEQ ID NO: 697450 - DNA, 25 bp, Rattus norvegicus
ttttcttagcatgtcagggtgggca

SEQ ID NO: 697451 - DNA, 25 bp, Rattus norvegicus
ttttcttatgaaatcctgcgggctg

SEQ ID NO: 697452 - DNA, 25 bp, Rattus norvegicus
ttttcttatgaattcctgcgggctg

SEQ ID NO: 697453 - DNA, 25 bp, Rattus norvegicus
ttttcttatgatcttctctcggaga

SEQ ID NO: 697454 - DNA, 25 bp, Rattus norvegicus
ttttcttatgatgttctctcggaga

SEQ ID NO: 697455 - DNA, 25 bp, Rattus norvegicus
ttttcttattaaaccgtgctctgta

SEQ ID NO: 697456 - DNA, 25 bp, Rattus norvegicus
ttttcttattaatccgtgctctgta

SEQ ID NO: 697457 - DNA, 25 bp, Rattus norvegicus
ttttcttcacacatctctggacatc

SEQ ID NO: 697458 - DNA, 25 bp, Rattus norvegicus
ttttcttcacacttctctggacatc

SEQ ID NO: 697459 - DNA, 25 bp, Rattus norvegicus
ttttcttcaccccttgaccgaagtg

SEQ ID NO: 697460 - DNA, 25 bp, Rattus norvegicus
ttttcttcacccgttgaccgaagtg

SEQ ID NO: 697461 - DNA, 25 bp, Rattus norvegicus
ttttcttcacctactttctggcagt

SEQ ID NO: 697462 - DNA, 25 bp, Rattus norvegicus
ttttcttcaccttctttctggcagt

SEQ ID NO: 697463 - DNA, 25 bp, Rattus norvegicus
ttttcttcagagacagtttcagttt

SEQ ID NO: 697464 - DNA, 25 bp, Rattus norvegicus
ttttcttcagagtcagtttcagttt

SEQ ID NO: 697465 - DNA, 25 bp, Rattus norvegicus
ttttcttcagccactcccatggaac

SEQ ID NO: 697466 - DNA, 25 bp, Rattus norvegicus
ttttcttcagcctctcccatggaac

SEQ ID NO: 697467 - DNA, 25 bp, Rattus norvegicus
ttttcttcccagagacagcgcatga

SEQ ID NO: 697468 - DNA, 25 bp, Rattus norvegicus
ttttcttcccagtgacagcgcatga

SEQ ID NO: 697469 - DNA, 25 bp, Rattus norvegicus
ttttcttccgacctgtctcgaaact

SEQ ID NO: 697470 - DNA, 25 bp, Rattus norvegicus
ttttcttccgacgtgtctcgaaact

SEQ ID NO: 697471 - DNA, 25 bp, Rattus norvegicus
ttttcttcctcccatctggaagaac

SEQ ID NO: 697472 - DNA, 25 bp, Rattus norvegicus
ttttcttcctccgatctggaagaac

SEQ ID NO: 697473 - DNA, 25 bp, Rattus norvegicus
ttttcttccttcagttaccatctaa

SEQ ID NO: 697474 - DNA, 25 bp, Rattus norvegicus
ttttcttccttctgttaccatctaa

SEQ ID NO: 697475 - DNA, 25 bp, Rattus norvegicus
ttttcttctaagaatctggagcccc

SEQ ID NO: 697476 - DNA, 25 bp, Rattus norvegicus
ttttcttctaagtatctggagcccc

SEQ ID NO: 697477 - DNA, 25 bp, Rattus norvegicus
ttttcttctattaatctctacctta

SEQ ID NO: 697478 - DNA, 25 bp, Rattus norvegicus
ttttcttctatttatctctacctta

SEQ ID NO: 697479 - DNA, 25 bp, Rattus norvegicus
ttttcttctcagatcctatttttat

SEQ ID NO: 697480 - DNA, 25 bp, Rattus norvegicus
ttttcttctcagttcctatttttat

SEQ ID NO: 697481 - DNA, 25 bp, Rattus norvegicus
ttttcttctccgactgggacttcct

SEQ ID NO: 697482 - DNA, 25 bp, Rattus norvegicus
ttttcttctccgtctgggacttcct

SEQ ID NO: 697483 - DNA, 25 bp, Rattus norvegicus
ttttcttctcctcaattcaaaaggg

SEQ ID NO: 697484 - DNA, 25 bp, Rattus norvegicus
ttttcttctcctgaattcaaaaggg

SEQ ID NO: 697485 - DNA, 25 bp, Rattus norvegicus
ttttcttctgcaaaaatgtactcat

SEQ ID NO: 697486 - DNA, 25 bp, Rattus norvegicus
ttttcttctgcataaatgtactcat

SEQ ID NO: 697487 - DNA, 25 bp, Rattus norvegicus
ttttcttctgtcaagctgtgtgatg

SEQ ID NO: 697488 - DNA, 25 bp, Rattus norvegicus
ttttcttctgtcctttgcactgata

SEQ ID NO: 697489 - DNA, 25 bp, Rattus norvegicus
ttttcttctgtcgtttgcactgata

SEQ ID NO: 697490 - DNA, 25 bp, Rattus norvegicus
ttttcttctgtctagctgtgtgatg

SEQ ID NO: 697491 - DNA, 25 bp, Rattus norvegicus
ttttcttcttctaggctttgccctc

SEQ ID NO: 697492 - DNA, 25 bp, Rattus norvegicus
ttttcttcttctcttcatctaaggc

SEQ ID NO: 697493 - DNA, 25 bp, Rattus norvegicus
ttttcttcttctgttcatctaaggc

SEQ ID NO: 697494 - DNA, 25 bp, Rattus norvegicus
ttttcttcttcttggctttgccctc

SEQ ID NO: 697495 - DNA, 25 bp, Rattus norvegicus
ttttcttcttgacgtctagtgacag

SEQ ID NO: 697496 - DNA, 25 bp, Rattus norvegicus
ttttcttcttgaggtctagtgacag

SEQ ID NO: 697497 - DNA, 25 bp, Rattus norvegicus
ttttcttctttactgtggacatagc

SEQ ID NO: 697498 - DNA, 25 bp, Rattus norvegicus
ttttcttctttagtgtggacatagc

SEQ ID NO: 697499 - DNA, 25 bp, Rattus norvegicus
ttttcttctttcaggtcccagtatt

SEQ ID NO: 697500 - DNA, 25 bp, Rattus norvegicus
ttttcttctttcctgagttccccag

SEQ ID NO: 697501 - DNA, 25 bp, Rattus norvegicus
ttttcttctttcgtgagttccccag

SEQ ID NO: 697502 - DNA, 25 bp, Rattus norvegicus
ttttcttctttctggtcccagtatt

SEQ ID NO: 697503 - DNA, 25 bp, Rattus norvegicus
ttttcttgcctaacaccggaccttt

SEQ ID NO: 697504 - DNA, 25 bp, Rattus norvegicus
ttttcttgcctatcaccggaccttt

SEQ ID NO: 697505 - DNA, 25 bp, Rattus norvegicus
ttttcttgccttaagacttggccca

SEQ ID NO: 697506 - DNA, 25 bp, Rattus norvegicus
ttttcttgcctttagacttggccca

SEQ ID NO: 697507 - DNA, 25 bp, Rattus norvegicus
ttttcttgggaaagggtgctggcaa

SEQ ID NO: 697508 - DNA, 25 bp, Rattus norvegicus
ttttcttgggaatgggtgctggcaa

SEQ ID NO: 697509 - DNA, 25 bp, Rattus norvegicus
ttttcttgtgtccttctcttactta

SEQ ID NO: 697510 - DNA, 25 bp, Rattus norvegicus
ttttcttgtgtcgttctcttactta

SEQ ID NO: 697511 - DNA, 25 bp, Rattus norvegicus
ttttcttgtgtgaaaaatcaaactg

SEQ ID NO: 697512 - DNA, 25 bp, Rattus norvegicus
ttttcttgtgtgtaaaatcaaactg

SEQ ID NO: 697513 - DNA, 25 bp, Rattus norvegicus
ttttcttgttccaggatcagtgatg

SEQ ID NO: 697514 - DNA, 25 bp, Rattus norvegicus
ttttcttgttcctggatcagtgatg

SEQ ID NO: 697515 - DNA, 25 bp, Rattus norvegicus
ttttcttgtttaactagccgtcctc

SEQ ID NO: 697516 - DNA, 25 bp, Rattus norvegicus
ttttcttgtttatctagccgtcctc

SEQ ID NO: 697517 - DNA, 25 bp, Rattus norvegicus
ttttctttacccatcactattactg

SEQ ID NO: 697518 - DNA, 25 bp, Rattus norvegicus
ttttctttacccttcactattactg

SEQ ID NO: 697519 - DNA, 25 bp, Rattus norvegicus
ttttctttagtcctggtgccatggc

SEQ ID NO: 697520 - DNA, 25 bp, Rattus norvegicus
ttttctttagtcgtggtgccatggc

SEQ ID NO: 697521 - DNA, 25 bp, Rattus norvegicus
ttttctttatatacactgcccaggc

SEQ ID NO: 697522 - DNA, 25 bp, Rattus norvegicus
ttttctttatattcactgcccaggc

SEQ ID NO: 697523 - DNA, 25 bp, Rattus norvegicus
ttttctttcaagataggatctcacc

SEQ ID NO: 697524 - DNA, 25 bp, Rattus norvegicus
ttttctttcaagttaggatctcacc

SEQ ID NO: 697525 - DNA, 25 bp, Rattus norvegicus
ttttctttccccatggagccaagat

SEQ ID NO: 697526 - DNA, 25 bp, Rattus norvegicus
ttttctttccccttggagccaagat

SEQ ID NO: 697527 - DNA, 25 bp, Rattus norvegicus
ttttctttccggagacctactctcg

SEQ ID NO: 697528 - DNA, 25 bp, Rattus norvegicus
ttttctttccggtgacctactctcg

SEQ ID NO: 697529 - DNA, 25 bp, Rattus norvegicus
ttttctttctagactgtggtccagc

SEQ ID NO: 697530 - DNA, 25 bp, Rattus norvegicus
ttttctttctagtctgtggtccagc

SEQ ID NO: 697531 - DNA, 25 bp, Rattus norvegicus
ttttctttcttcagcagaggccaga

SEQ ID NO: 697532 - DNA, 25 bp, Rattus norvegicus
ttttctttcttctgcagaggccaga

SEQ ID NO: 697533 - DNA, 25 bp, Rattus norvegicus
ttttctttcttgcttttgcaacatc

SEQ ID NO: 697534 - DNA, 25 bp, Rattus norvegicus
ttttctttcttggttttgcaacatc

SEQ ID NO: 697535 - DNA, 25 bp, Rattus norvegicus
ttttctttctttcatgggacacttg

SEQ ID NO: 697536 - DNA, 25 bp, Rattus norvegicus
ttttctttctttcggctctgtggct

SEQ ID NO: 697537 - DNA, 25 bp, Rattus norvegicus
ttttctttctttgatgggacacttg

SEQ ID NO: 697538 - DNA, 25 bp, Rattus norvegicus
ttttctttctttgggctctgtggct

SEQ ID NO: 697539 - DNA, 25 bp, Rattus norvegicus
ttttctttgggaacagctgctgttc

SEQ ID NO: 697540 - DNA, 25 bp, Rattus norvegicus
ttttctttgggatcagctgctgttc

SEQ ID NO: 697541 - DNA, 25 bp, Rattus norvegicus
ttttctttggttcccgacaaaacag

SEQ ID NO: 697542 - DNA, 25 bp, Rattus norvegicus
ttttctttggttctgcattatgata

SEQ ID NO: 697543 - DNA, 25 bp, Rattus norvegicus
ttttctttggttgccgacaaaacag

SEQ ID NO: 697544 - DNA, 25 bp, Rattus norvegicus
ttttctttggttgtgcattatgata

SEQ ID NO: 697545 - DNA, 25 bp, Rattus norvegicus
ttttctttgttcactatgctgggca

SEQ ID NO: 697546 - DNA, 25 bp, Rattus norvegicus
ttttctttgttctctatgctgggca

SEQ ID NO: 697547 - DNA, 25 bp, Rattus norvegicus
ttttctttgttgatgtggacctact

SEQ ID NO: 697548 - DNA, 25 bp, Rattus norvegicus
ttttctttgttgttgtggacctact

SEQ ID NO: 697549 - DNA, 25 bp, Rattus norvegicus
ttttcttttagcataatggcctggg

SEQ ID NO: 697550 - DNA, 25 bp, Rattus norvegicus
ttttcttttagcttaatggcctggg

SEQ ID NO: 697551 - DNA, 25 bp, Rattus norvegicus
ttttcttttcatctactctgttctg

SEQ ID NO: 697552 - DNA, 25 bp, Rattus norvegicus
ttttcttttcatgtactctgttctg

SEQ ID NO: 697553 - DNA, 25 bp, Rattus norvegicus
ttttcttttccaatcagctgttcag

SEQ ID NO: 697554 - DNA, 25 bp, Rattus norvegicus
ttttcttttccattcagctgttcag

SEQ ID NO: 697555 - DNA, 25 bp, Rattus norvegicus
ttttcttttctaactcagagtccct

SEQ ID NO: 697556 - DNA, 25 bp, Rattus norvegicus
ttttcttttctatctcagagtccct

SEQ ID NO: 697557 - DNA, 25 bp, Rattus norvegicus
ttttcttttctcagactgagccctg

SEQ ID NO: 697558 - DNA, 25 bp, Rattus norvegicus
ttttcttttctctgactgagccctg

SEQ ID NO: 697559 - DNA, 25 bp, Rattus norvegicus
ttttcttttcttcatccagcacagc

SEQ ID NO: 697560 - DNA, 25 bp, Rattus norvegicus
ttttcttttcttgatccagcacagc

SEQ ID NO: 697561 - DNA, 25 bp, Rattus norvegicus
ttttcttttgccaccagcctgagac

SEQ ID NO: 697562 - DNA, 25 bp, Rattus norvegicus
ttttcttttgcctccagcctgagac

SEQ ID NO: 697563 - DNA, 25 bp, Rattus norvegicus
ttttctttttagatctctctgattt

SEQ ID NO: 697564 - DNA, 25 bp, Rattus norvegicus
ttttctttttagttctctctgattt

SEQ ID NO: 697565 - DNA, 25 bp, Rattus norvegicus
ttttcttttttgagccacttggtgt

SEQ ID NO: 697566 - DNA, 25 bp, Rattus norvegicus
ttttcttttttgtgccacttggtgt

SEQ ID NO: 697567 - DNA, 25 bp, Rattus norvegicus
ttttgaaaaatgaacttgggcctgg

SEQ ID NO: 697568 - DNA, 25 bp, Rattus norvegicus
ttttgaaaaatgtacttgggcctgg

SEQ ID NO: 697569 - DNA, 25 bp, Rattus norvegicus
ttttgaaaacagctctcactacata

SEQ ID NO: 697570 - DNA, 25 bp, Rattus norvegicus
ttttgaaaacaggtctcactacata

SEQ ID NO: 697571 - DNA, 25 bp, Rattus norvegicus
ttttgaaagaggcattagctgcact

SEQ ID NO: 697572 - DNA, 25 bp, Rattus norvegicus
ttttgaaagagggattagctgcact

SEQ ID NO: 697573 - DNA, 25 bp, Rattus norvegicus
ttttgaaatctgaccttggccctgg

SEQ ID NO: 697574 - DNA, 25 bp, Rattus norvegicus
ttttgaaatctgtccttggccctgg

SEQ ID NO: 697575 - DNA, 25 bp, Rattus norvegicus
ttttgaaatgatccacagacacccc

SEQ ID NO: 697576 - DNA, 25 bp, Rattus norvegicus
ttttgaaatgatgcacagacacccc

SEQ ID NO: 697577 - DNA, 25 bp, Rattus norvegicus
ttttgaacatcaacagaggctggag

SEQ ID NO: 697578 - DNA, 25 bp, Rattus norvegicus
ttttgaacatcatcagaggctggag

SEQ ID NO: 697579 - DNA, 25 bp, Rattus norvegicus
ttttgaaccaacagtgagaaccttt

SEQ ID NO: 697580 - DNA, 25 bp, Rattus norvegicus
ttttgaaccaactgtgagaaccttt

SEQ ID NO: 697581 - DNA, 25 bp, Rattus norvegicus
ttttgaacccatcctgaaatccctc

SEQ ID NO: 697582 - DNA, 25 bp, Rattus norvegicus
ttttgaacccatgctgaaatccctc

SEQ ID NO: 697583 - DNA, 25 bp, Rattus norvegicus
ttttgaactcagagtctaatccttg

SEQ ID NO: 697584 - DNA, 25 bp, Rattus norvegicus
ttttgaactcagtgtctaatccttg

SEQ ID NO: 697585 - DNA, 25 bp, Rattus norvegicus
ttttgaactccaagttccccttcat

SEQ ID NO: 697586 - DNA, 25 bp, Rattus norvegicus
ttttgaactccatgttccccttcat

SEQ ID NO: 697587 - DNA, 25 bp, Rattus norvegicus
ttttgaagagcaagcgcgcgcacac

SEQ ID NO: 697588 - DNA, 25 bp, Rattus norvegicus
ttttgaagagcatgcgcgcgcacac

SEQ ID NO: 697589 - DNA, 25 bp, Rattus norvegicus
ttttgaagcaccctctagcagatgg

SEQ ID NO: 697590 - DNA, 25 bp, Rattus norvegicus
ttttgaagcaccgtctagcagatgg

SEQ ID NO: 697591 - DNA, 25 bp, Rattus norvegicus
ttttgaaggactcgcctaccttgtc

SEQ ID NO: 697592 - DNA, 25 bp, Rattus norvegicus
ttttgaaggactggcctaccttgtc

SEQ ID NO: 697593 - DNA, 25 bp, Rattus norvegicus
ttttgaagtctcacacaagctgtgt

SEQ ID NO: 697594 - DNA, 25 bp, Rattus norvegicus
ttttgaagtctctcacaagctgtgt

SEQ ID NO: 697595 - DNA, 25 bp, Rattus norvegicus
ttttgaatattcctgagccccatga

SEQ ID NO: 697596 - DNA, 25 bp, Rattus norvegicus
ttttgaatattcgtgagccccatga

SEQ ID NO: 697597 - DNA, 25 bp, Rattus norvegicus
ttttgaatcttccttgtgcatcctg

SEQ ID NO: 697598 - DNA, 25 bp, Rattus norvegicus
ttttgaatcttcgttgtgcatcctg

SEQ ID NO: 697599 - DNA, 25 bp, Rattus norvegicus
ttttgaatgcctcctgcggctcgga

SEQ ID NO: 697600 - DNA, 25 bp, Rattus norvegicus
ttttgaatgcctgctgcggctcgga

SEQ ID NO: 697601 - DNA, 25 bp, Rattus norvegicus
ttttgaattcacaaccttaggtcct

SEQ ID NO: 697602 - DNA, 25 bp, Rattus norvegicus
ttttgaattcactaccttaggtcct

SEQ ID NO: 697603 - DNA, 25 bp, Rattus norvegicus
ttttgaatttcacctacacctagat

SEQ ID NO: 697604 - DNA, 25 bp, Rattus norvegicus
ttttgaatttcagctacacctagat

SEQ ID NO: 697605 - DNA, 25 bp, Rattus norvegicus
ttttgaatttggatctccggtgact

SEQ ID NO: 697606 - DNA, 25 bp, Rattus norvegicus
ttttgaatttggttctccggtgact

SEQ ID NO: 697607 - DNA, 25 bp, Rattus norvegicus
ttttgacaaaagcttaaaaccacat

SEQ ID NO: 697608 - DNA, 25 bp, Rattus norvegicus
ttttgacaaaaggttaaaaccacat

SEQ ID NO: 697609 - DNA, 25 bp, Rattus norvegicus
ttttgacaccaccattaaggactgt

SEQ ID NO: 697610 - DNA, 25 bp, Rattus norvegicus
ttttgacaccacgattaaggactgt

SEQ ID NO: 697611 - DNA, 25 bp, Rattus norvegicus
ttttgacagccacttgggcagaggg

SEQ ID NO: 697612 - DNA, 25 bp, Rattus norvegicus
ttttgacagccagttgggcagaggg

SEQ ID NO: 697613 - DNA, 25 bp, Rattus norvegicus
ttttgaccaggtctaccgagagcaa

SEQ ID NO: 697614 - DNA, 25 bp, Rattus norvegicus
ttttgaccaggtgtaccgagagcaa

SEQ ID NO: 697615 - DNA, 25 bp, Rattus norvegicus
ttttgacccgctagtctagagccga

SEQ ID NO: 697616 - DNA, 25 bp, Rattus norvegicus
ttttgacccgcttgtctagagccga

SEQ ID NO: 697617 - DNA, 25 bp, Rattus norvegicus
ttttgaccgaaaccttctatttact

SEQ ID NO: 697618 - DNA, 25 bp, Rattus norvegicus
ttttgaccgaaagcttctatttact

SEQ ID NO: 697619 - DNA, 25 bp, Rattus norvegicus
ttttgacctagcctttgcctgtcac

SEQ ID NO: 697620 - DNA, 25 bp, Rattus norvegicus
ttttgacctagcgtttgcctgtcac

SEQ ID NO: 697621 - DNA, 25 bp, Rattus norvegicus
ttttgaccttccatggccactgcac

SEQ ID NO: 697622 - DNA, 25 bp, Rattus norvegicus
ttttgaccttccttggccactgcac

SEQ ID NO: 697623 - DNA, 25 bp, Rattus norvegicus
ttttgacgacatccccaactacgaa

SEQ ID NO: 697624 - DNA, 25 bp, Rattus norvegicus
ttttgacgacatgcccaactacgaa

SEQ ID NO: 697625 - DNA, 25 bp, Rattus norvegicus
ttttgacggttcatgtacatgtaca

SEQ ID NO: 697626 - DNA, 25 bp, Rattus norvegicus
ttttgacggttcttgtacatgtaca

SEQ ID NO: 697627 - DNA, 25 bp, Rattus norvegicus
ttttgactacacattggctttggag

SEQ ID NO: 697628 - DNA, 25 bp, Rattus norvegicus
ttttgactacactttggctttggag

SEQ ID NO: 697629 - DNA, 25 bp, Rattus norvegicus
ttttgactagacagtccttgaactc

SEQ ID NO: 697630 - DNA, 25 bp, Rattus norvegicus
ttttgactagactgtccttgaactc

SEQ ID NO: 697631 - DNA, 25 bp, Rattus norvegicus
ttttgactaggcaccaggccagctt

SEQ ID NO: 697632 - DNA, 25 bp, Rattus norvegicus
ttttgactaggctccaggccagctt

SEQ ID NO: 697633 - DNA, 25 bp, Rattus norvegicus
ttttgactcattatcatgctcccaa

SEQ ID NO: 697634 - DNA, 25 bp, Rattus norvegicus
ttttgactcattttcatgctcccaa

SEQ ID NO: 697635 - DNA, 25 bp, Rattus norvegicus
ttttgactccagcatcccaaatgtg

SEQ ID NO: 697636 - DNA, 25 bp, Rattus norvegicus
ttttgactccaggatcccaaatgtg

SEQ ID NO: 697637 - DNA, 25 bp, Rattus norvegicus
ttttgactcgtgcaaaatgcccaac

SEQ ID NO: 697638 - DNA, 25 bp, Rattus norvegicus
ttttgactcgtggaaaatgcccaac

SEQ ID NO: 697639 - DNA, 25 bp, Rattus norvegicus
ttttgacttattaaataccactggg

SEQ ID NO: 697640 - DNA, 25 bp, Rattus norvegicus
ttttgacttatttaataccactggg

SEQ ID NO: 697641 - DNA, 25 bp, Rattus norvegicus
ttttgacttccacacgtaagccatg

SEQ ID NO: 697642 - DNA, 25 bp, Rattus norvegicus
ttttgacttccagacgtaagccatg

SEQ ID NO: 697643 - DNA, 25 bp, Rattus norvegicus
ttttgagacagaccctcaccgtgta

SEQ ID NO: 697644 - DNA, 25 bp, Rattus norvegicus
ttttgagacagagcctcaccgtgta

SEQ ID NO: 697645 - DNA, 25 bp, Rattus norvegicus
ttttgagagaccctccagacatctc

SEQ ID NO: 697646 - DNA, 25 bp, Rattus norvegicus
ttttgagagaccgtccagacatctc

SEQ ID NO: 697647 - DNA, 25 bp, Rattus norvegicus
ttttgagagttactgttttcctctt

SEQ ID NO: 697648 - DNA, 25 bp, Rattus norvegicus
ttttgagagttagtgttttcctctt

SEQ ID NO: 697649 - DNA, 25 bp, Rattus norvegicus
ttttgagatggtagcacctgggaat

SEQ ID NO: 697650 - DNA, 25 bp, Rattus norvegicus
ttttgagatggttgcacctgggaat

SEQ ID NO: 697651 - DNA, 25 bp, Rattus norvegicus
ttttgagccatgcacatgggttgta

SEQ ID NO: 697652 - DNA, 25 bp, Rattus norvegicus
ttttgagccatggacatgggttgta

SEQ ID NO: 697653 - DNA, 25 bp, Rattus norvegicus
ttttgagcccacaaaagtctcttgg

SEQ ID NO: 697654 - DNA, 25 bp, Rattus norvegicus
ttttgagcccactaaagtctcttgg

SEQ ID NO: 697655 - DNA, 25 bp, Rattus norvegicus
ttttgagccccgagtggcaaaggct

SEQ ID NO: 697656 - DNA, 25 bp, Rattus norvegicus
ttttgagccccgtgtggcaaaggct

SEQ ID NO: 697657 - DNA, 25 bp, Rattus norvegicus
ttttgagccctacagcagactagaa

SEQ ID NO: 697658 - DNA, 25 bp, Rattus norvegicus
ttttgagccctagagcagactagaa

SEQ ID NO: 697659 - DNA, 25 bp, Rattus norvegicus
ttttgagccgctctggcgcaaggac

SEQ ID NO: 697660 - DNA, 25 bp, Rattus norvegicus
ttttgagccgctgtggcgcaaggac

SEQ ID NO: 697661 - DNA, 25 bp, Rattus norvegicus
ttttgagcctctccagctgatgacc

SEQ ID NO: 697662 - DNA, 25 bp, Rattus norvegicus
ttttgagcctctgcagctgatgacc

SEQ ID NO: 697663 - DNA, 25 bp, Rattus norvegicus
ttttgagctctcatgaaccttgtcc

SEQ ID NO: 697664 - DNA, 25 bp, Rattus norvegicus
ttttgagctctcttgaaccttgtcc

SEQ ID NO: 697665 - DNA, 25 bp, Rattus norvegicus
ttttgagctgctcttttcctgtata

SEQ ID NO: 697666 - DNA, 25 bp, Rattus norvegicus
ttttgagctgctgttttcctgtata

SEQ ID NO: 697667 - DNA, 25 bp, Rattus norvegicus
ttttgagctggcacggaacccagat

SEQ ID NO: 697668 - DNA, 25 bp, Rattus norvegicus
ttttgagctggctcggaacccagat

SEQ ID NO: 697669 - DNA, 25 bp, Rattus norvegicus
ttttgagcttctaggcttggaggct

SEQ ID NO: 697670 - DNA, 25 bp, Rattus norvegicus
ttttgagcttcttggcttggaggct

SEQ ID NO: 697671 - DNA, 25 bp, Rattus norvegicus
ttttgaggagtactgccgttccgca

SEQ ID NO: 697672 - DNA, 25 bp, Rattus norvegicus
ttttgaggagtagtgccgttccgca

SEQ ID NO: 697673 - DNA, 25 bp, Rattus norvegicus
ttttgaggccaacacaggaagatca

SEQ ID NO: 697674 - DNA, 25 bp, Rattus norvegicus
ttttgaggccaagacaggaagatca

SEQ ID NO: 697675 - DNA, 25 bp, Rattus norvegicus
ttttgaggctatatcgggctacgta

SEQ ID NO: 697676 - DNA, 25 bp, Rattus norvegicus
ttttgaggctatttcgggctacgta

SEQ ID NO: 697677 - DNA, 25 bp, Rattus norvegicus
ttttgagggactatgcgagcgccgc

SEQ ID NO: 697678 - DNA, 25 bp, Rattus norvegicus
ttttgagggactttgcgagcgccgc

SEQ ID NO: 697679 - DNA, 25 bp, Rattus norvegicus
ttttgaggtctacgcctgggaccaa

SEQ ID NO: 697680 - DNA, 25 bp, Rattus norvegicus
ttttgaggtctaggcctgggaccaa

SEQ ID NO: 697681 - DNA, 25 bp, Rattus norvegicus
ttttgaggtgagctttggtcctgcc

SEQ ID NO: 697682 - DNA, 25 bp, Rattus norvegicus
ttttgaggtgaggtttggtcctgcc

SEQ ID NO: 697683 - DNA, 25 bp, Rattus norvegicus
ttttgaggtgctcccttcagtcact

SEQ ID NO: 697684 - DNA, 25 bp, Rattus norvegicus
ttttgaggtgctgccttcagtcact

SEQ ID NO: 697685 - DNA, 25 bp, Rattus norvegicus
ttttgagtaataaccccagcctaag

SEQ ID NO: 697686 - DNA, 25 bp, Rattus norvegicus
ttttgagtaatatccccagcctaag

SEQ ID NO: 697687 - DNA, 25 bp, Rattus norvegicus
ttttgagtacagaacctatcccata

SEQ ID NO: 697688 - DNA, 25 bp, Rattus norvegicus
ttttgagtacagtacctatcccata

SEQ ID NO: 697689 - DNA, 25 bp, Rattus norvegicus
ttttgagtagcacggcacatgtccc

SEQ ID NO: 697690 - DNA, 25 bp, Rattus norvegicus
ttttgagtagcagggcacatgtccc

SEQ ID NO: 697691 - DNA, 25 bp, Rattus norvegicus
ttttgagtccgacctgcgcgcagcg

SEQ ID NO: 697692 - DNA, 25 bp, Rattus norvegicus
ttttgagtccgagctgcgcgcagcg

SEQ ID NO: 697693 - DNA, 25 bp, Rattus norvegicus
ttttgagtcctcagcgtgcatgcat

SEQ ID NO: 697694 - DNA, 25 bp, Rattus norvegicus
ttttgagtcctctgcgtgcatgcat

SEQ ID NO: 697695 - DNA, 25 bp, Rattus norvegicus
ttttgagtgagcagtatcttggtaa

SEQ ID NO: 697696 - DNA, 25 bp, Rattus norvegicus
ttttgagtgagctgtatcttggtaa

SEQ ID NO: 697697 - DNA, 25 bp, Rattus norvegicus
ttttgagtgtccatgcagcaatttt

SEQ ID NO: 697698 - DNA, 25 bp, Rattus norvegicus
ttttgagtgtccttgcagcaatttt

SEQ ID NO: 697699 - DNA, 25 bp, Rattus norvegicus
ttttgagtgttcactggaccagggc

SEQ ID NO: 697700 - DNA, 25 bp, Rattus norvegicus
ttttgagtgttctctggaccagggc

SEQ ID NO: 697701 - DNA, 25 bp, Rattus norvegicus
ttttgagtgttgatgggaaagccca

SEQ ID NO: 697702 - DNA, 25 bp, Rattus norvegicus
ttttgagtgttgttgggaaagccca

SEQ ID NO: 697703 - DNA, 25 bp, Rattus norvegicus
ttttgagttcgaccggtgcagcacc

SEQ ID NO: 697704 - DNA, 25 bp, Rattus norvegicus
ttttgagttcgagcggtgcagcacc

SEQ ID NO: 697705 - DNA, 25 bp, Rattus norvegicus
ttttgagtttgacccactttctacc

SEQ ID NO: 697706 - DNA, 25 bp, Rattus norvegicus
ttttgagtttgagccactttctacc

SEQ ID NO: 697707 - DNA, 25 bp, Rattus norvegicus
ttttgataaaccaccgtcacgtcat

SEQ ID NO: 697708 - DNA, 25 bp, Rattus norvegicus
ttttgataaacctccgtcacgtcat

SEQ ID NO: 697709 - DNA, 25 bp, Rattus norvegicus
ttttgataacccctatggagcagcc

SEQ ID NO: 697710 - DNA, 25 bp, Rattus norvegicus
ttttgataacccgtatggagcagcc

SEQ ID NO: 697711 - DNA, 25 bp, Rattus norvegicus
ttttgatagtaaccatgtcctctgt

SEQ ID NO: 697712 - DNA, 25 bp, Rattus norvegicus
ttttgatagtaagcatgtcctctgt

SEQ ID NO: 697713 - DNA, 25 bp, Rattus norvegicus
ttttgatatagtccaggcggttgcc

SEQ ID NO: 697714 - DNA, 25 bp, Rattus norvegicus
ttttgatatagtgcaggcggttgcc

SEQ ID NO: 697715 - DNA, 25 bp, Rattus norvegicus
ttttgatatcagagactccccatcc

SEQ ID NO: 697716 - DNA, 25 bp, Rattus norvegicus
ttttgatatcagtgactccccatcc

SEQ ID NO: 697717 - DNA, 25 bp, Rattus norvegicus
ttttgatcagaactgtttccagcat

SEQ ID NO: 697718 - DNA, 25 bp, Rattus norvegicus
ttttgatcagaagtgtttccagcat

SEQ ID NO: 697719 - DNA, 25 bp, Rattus norvegicus
ttttgatcccaaaatgctgcggagc

SEQ ID NO: 697720 - DNA, 25 bp, Rattus norvegicus
ttttgatcccaatatgctgcggagc

SEQ ID NO: 697721 - DNA, 25 bp, Rattus norvegicus
ttttgatccctccagaaggcctgag

SEQ ID NO: 697722 - DNA, 25 bp, Rattus norvegicus
ttttgatccctcgagaaggcctgag

SEQ ID NO: 697723 - DNA, 25 bp, Rattus norvegicus
ttttgatccgagacgattactccct

SEQ ID NO: 697724 - DNA, 25 bp, Rattus norvegicus
ttttgatccgagtcgattactccct

SEQ ID NO: 697725 - DNA, 25 bp, Rattus norvegicus
ttttgatccggcagtcttgggagac

SEQ ID NO: 697726 - DNA, 25 bp, Rattus norvegicus
ttttgatccggctgtcttgggagac

SEQ ID NO: 697727 - DNA, 25 bp, Rattus norvegicus
ttttgatctaagacgccttccagga

SEQ ID NO: 697728 - DNA, 25 bp, Rattus norvegicus
ttttgatctaagtcgccttccagga

SEQ ID NO: 697729 - DNA, 25 bp, Rattus norvegicus
ttttgatctccgatttcgcgacagt

SEQ ID NO: 697730 - DNA, 25 bp, Rattus norvegicus
ttttgatctccgttttcgcgacagt

SEQ ID NO: 697731 - DNA, 25 bp, Rattus norvegicus
ttttgatctcgcagagcccggcgtt

SEQ ID NO: 697732 - DNA, 25 bp, Rattus norvegicus
ttttgatctcgctgagcccggcgtt

SEQ ID NO: 697733 - DNA, 25 bp, Rattus norvegicus
ttttgatgccaaaggatcttcagtt

SEQ ID NO: 697734 - DNA, 25 bp, Rattus norvegicus
ttttgatgccaatggatcttcagtt

SEQ ID NO: 697735 - DNA, 25 bp, Rattus norvegicus
ttttgatgccgtactttctgttcgc

SEQ ID NO: 697736 - DNA, 25 bp, Rattus norvegicus
ttttgatgccgttctttctgttcgc

SEQ ID NO: 697737 - DNA, 25 bp, Rattus norvegicus
ttttgatgctcccttgggctacaaa

SEQ ID NO: 697738 - DNA, 25 bp, Rattus norvegicus
ttttgatgctccgttgggctacaaa

SEQ ID NO: 697739 - DNA, 25 bp, Rattus norvegicus
ttttgatgctgtcgtggcttctgaa

SEQ ID NO: 697740 - DNA, 25 bp, Rattus norvegicus
ttttgatgctgtggtggcttctgaa

SEQ ID NO: 697741 - DNA, 25 bp, Rattus norvegicus
ttttgatggttgatttcctcccatt

SEQ ID NO: 697742 - DNA, 25 bp, Rattus norvegicus
ttttgatggttgttttcctcccatt

SEQ ID NO: 697743 - DNA, 25 bp, Rattus norvegicus
ttttgatgttttcgccatcccacac

SEQ ID NO: 697744 - DNA, 25 bp, Rattus norvegicus
ttttgatgttttggccatcccacac

SEQ ID NO: 697745 - DNA, 25 bp, Rattus norvegicus
ttttgattattcctctttgctgtcc

SEQ ID NO: 697746 - DNA, 25 bp, Rattus norvegicus
ttttgattattcgtctttgctgtcc

SEQ ID NO: 697747 - DNA, 25 bp, Rattus norvegicus
ttttgatttcctcatactctctctc

SEQ ID NO: 697748 - DNA, 25 bp, Rattus norvegicus
ttttgatttcctgatactctctctc

SEQ ID NO: 697749 - DNA, 25 bp, Rattus norvegicus
ttttgcaaaacgctgtcgtctcgag

SEQ ID NO: 697750 - DNA, 25 bp, Rattus norvegicus
ttttgcaaaacggtgtcgtctcgag

SEQ ID NO: 697751 - DNA, 25 bp, Rattus norvegicus
ttttgcaacaccatcacctttgaca

SEQ ID NO: 697752 - DNA, 25 bp, Rattus norvegicus
ttttgcaacaccttcacctttgaca

SEQ ID NO: 697753 - DNA, 25 bp, Rattus norvegicus
ttttgcaactatcccagggctgcca

SEQ ID NO: 697754 - DNA, 25 bp, Rattus norvegicus
ttttgcaactatgccagggctgcca

SEQ ID NO: 697755 - DNA, 25 bp, Rattus norvegicus
ttttgcaattcgcttgattatcccc

SEQ ID NO: 697756 - DNA, 25 bp, Rattus norvegicus
ttttgcaattcggttgattatcccc

SEQ ID NO: 697757 - DNA, 25 bp, Rattus norvegicus
ttttgcaccaatactgtatcctgta

SEQ ID NO: 697758 - DNA, 25 bp, Rattus norvegicus
ttttgcaccaattctgtatcctgta

SEQ ID NO: 697759 - DNA, 25 bp, Rattus norvegicus
ttttgcaccagcctgtatttctctc

SEQ ID NO: 697760 - DNA, 25 bp, Rattus norvegicus
ttttgcaccagcgtgtatttctctc

SEQ ID NO: 697761 - DNA, 25 bp, Rattus norvegicus
ttttgcaccattcctagtccacaga

SEQ ID NO: 697762 - DNA, 25 bp, Rattus norvegicus
ttttgcaccattgctagtccacaga

SEQ ID NO: 697763 - DNA, 25 bp, Rattus norvegicus
ttttgcaccggtctccagactagaa

SEQ ID NO: 697764 - DNA, 25 bp, Rattus norvegicus
ttttgcaccggtgtccagactagaa

SEQ ID NO: 697765 - DNA, 25 bp, Rattus norvegicus
ttttgcactgtcacaatgactccct

SEQ ID NO: 697766 - DNA, 25 bp, Rattus norvegicus
ttttgcactgtctcaatgactccct

SEQ ID NO: 697767 - DNA, 25 bp, Rattus norvegicus
ttttgcacttttatgaccgaaagct

SEQ ID NO: 697768 - DNA, 25 bp, Rattus norvegicus
ttttgcacttttttgaccgaaagct

SEQ ID NO: 697769 - DNA, 25 bp, Rattus norvegicus
ttttgcagacagacgcattgactct

SEQ ID NO: 697770 - DNA, 25 bp, Rattus norvegicus
ttttgcagacagtcgcattgactct

SEQ ID NO: 697771 - DNA, 25 bp, Rattus norvegicus
ttttgcagagcgagcagggcacgat

SEQ ID NO: 697772 - DNA, 25 bp, Rattus norvegicus
ttttgcagagcgtgcagggcacgat

SEQ ID NO: 697773 - DNA, 25 bp, Rattus norvegicus
ttttgcagatcacacatgcgctcta

SEQ ID NO: 697774 - DNA, 25 bp, Rattus norvegicus
ttttgcagatcagacatgcgctcta

SEQ ID NO: 697775 - DNA, 25 bp, Rattus norvegicus
ttttgcagattcatccccatccttg

SEQ ID NO: 697776 - DNA, 25 bp, Rattus norvegicus
ttttgcagattcttccccatccttg

SEQ ID NO: 697777 - DNA, 25 bp, Rattus norvegicus
ttttgcagcaagctgctgtgaccct

SEQ ID NO: 697778 - DNA, 25 bp, Rattus norvegicus
ttttgcagcaaggtgctgtgaccct

SEQ ID NO: 697779 - DNA, 25 bp, Rattus norvegicus
ttttgcagggtcagcaagatggctc

SEQ ID NO: 697780 - DNA, 25 bp, Rattus norvegicus
ttttgcagggtctgcaagatggctc

SEQ ID NO: 697781 - DNA, 25 bp, Rattus norvegicus
ttttgcagtcccaggcatctgaatt

SEQ ID NO: 697782 - DNA, 25 bp, Rattus norvegicus
ttttgcagtccctggcatctgaatt

SEQ ID NO: 697783 - DNA, 25 bp, Rattus norvegicus
ttttgcagtgaccacccgaggtgat

SEQ ID NO: 697784 - DNA, 25 bp, Rattus norvegicus
ttttgcagtgacgacccgaggtgat

SEQ ID NO: 697785 - DNA, 25 bp, Rattus norvegicus
ttttgcatatttcgactcagctatc

SEQ ID NO: 697786 - DNA, 25 bp, Rattus norvegicus
ttttgcatatttggactcagctatc

SEQ ID NO: 697787 - DNA, 25 bp, Rattus norvegicus
ttttgcatcaaaaacggcacagcga

SEQ ID NO: 697788 - DNA, 25 bp, Rattus norvegicus
ttttgcatcaaatacggcacagcga

SEQ ID NO: 697789 - DNA, 25 bp, Rattus norvegicus
ttttgcatcaaccatctgaccgtag

SEQ ID NO: 697790 - DNA, 25 bp, Rattus norvegicus
ttttgcatcaacgatctgaccgtag

SEQ ID NO: 697791 - DNA, 25 bp, Rattus norvegicus
ttttgcattcaccaccttagttaat

SEQ ID NO: 697792 - DNA, 25 bp, Rattus norvegicus
ttttgcattcacgaccttagttaat

SEQ ID NO: 697793 - DNA, 25 bp, Rattus norvegicus
ttttgcattgtcatttcctgctttt

SEQ ID NO: 697794 - DNA, 25 bp, Rattus norvegicus
ttttgcattgtcttttcctgctttt

SEQ ID NO: 697795 - DNA, 25 bp, Rattus norvegicus
ttttgcatttgccttctggcattgg

SEQ ID NO: 697796 - DNA, 25 bp, Rattus norvegicus
ttttgcatttgcgttctggcattgg

SEQ ID NO: 697797 - DNA, 25 bp, Rattus norvegicus
ttttgcatttgtcggtttcttaaag

SEQ ID NO: 697798 - DNA, 25 bp, Rattus norvegicus
ttttgcatttgtgggtttcttaaag

SEQ ID NO: 697799 - DNA, 25 bp, Rattus norvegicus
ttttgcattttgcactatatggctc

SEQ ID NO: 697800 - DNA, 25 bp, Rattus norvegicus
ttttgcattttggactatatggctc

SEQ ID NO: 697801 - DNA, 25 bp, Rattus norvegicus
ttttgccaagaactagcacctttcc

SEQ ID NO: 697802 - DNA, 25 bp, Rattus norvegicus
ttttgccaagaagtagcacctttcc

SEQ ID NO: 697803 - DNA, 25 bp, Rattus norvegicus
ttttgccaattgactattcccaagt

SEQ ID NO: 697804 - DNA, 25 bp, Rattus norvegicus
ttttgccaattgtctattcccaagt

SEQ ID NO: 697805 - DNA, 25 bp, Rattus norvegicus
ttttgccacatcaactctgtatcat

SEQ ID NO: 697806 - DNA, 25 bp, Rattus norvegicus
ttttgccacatctactctgtatcat

SEQ ID NO: 697807 - DNA, 25 bp, Rattus norvegicus
ttttgccacccgcaagattgcagtg

SEQ ID NO: 697808 - DNA, 25 bp, Rattus norvegicus
ttttgccacccggaagattgcagtg

SEQ ID NO: 697809 - DNA, 25 bp, Rattus norvegicus
ttttgccaccttaaaggtttgagct

SEQ ID NO: 697810 - DNA, 25 bp, Rattus norvegicus
ttttgccacctttaaggtttgagct

SEQ ID NO: 697811 - DNA, 25 bp, Rattus norvegicus
ttttgccaggctatggtctaagttg

SEQ ID NO: 697812 - DNA, 25 bp, Rattus norvegicus
ttttgccaggctttggtctaagttg

SEQ ID NO: 697813 - DNA, 25 bp, Rattus norvegicus
ttttgccagggtataggagtattca

SEQ ID NO: 697814 - DNA, 25 bp, Rattus norvegicus
ttttgccagggtttaggagtattca

SEQ ID NO: 697815 - DNA, 25 bp, Rattus norvegicus
ttttgccatccgcagagcttgactc

SEQ ID NO: 697816 - DNA, 25 bp, Rattus norvegicus
ttttgccatccggagagcttgactc

SEQ ID NO: 697817 - DNA, 25 bp, Rattus norvegicus
ttttgccatgcaagatgtacccctg

SEQ ID NO: 697818 - DNA, 25 bp, Rattus norvegicus
ttttgccatgcactattatactttt

SEQ ID NO: 697819 - DNA, 25 bp, Rattus norvegicus
ttttgccatgcagtattatactttt

SEQ ID NO: 697820 - DNA, 25 bp, Rattus norvegicus
ttttgccatgcatgatgtacccctg

SEQ ID NO: 697821 - DNA, 25 bp, Rattus norvegicus
ttttgccatgtgcttgggctccaaa

SEQ ID NO: 697822 - DNA, 25 bp, Rattus norvegicus
ttttgccatgtggttgggctccaaa

SEQ ID NO: 697823 - DNA, 25 bp, Rattus norvegicus
ttttgccattccatcagtggaggtc

SEQ ID NO: 697824 - DNA, 25 bp, Rattus norvegicus
ttttgccattccttcagtggaggtc

SEQ ID NO: 697825 - DNA, 25 bp, Rattus norvegicus
ttttgcccagttaggttctgatctg

SEQ ID NO: 697826 - DNA, 25 bp, Rattus norvegicus
ttttgcccagtttggttctgatctg

SEQ ID NO: 697827 - DNA, 25 bp, Rattus norvegicus
ttttgcccatagagccattagtaga

SEQ ID NO: 697828 - DNA, 25 bp, Rattus norvegicus
ttttgcccatagtgccattagtaga

SEQ ID NO: 697829 - DNA, 25 bp, Rattus norvegicus
ttttgccccaaaatcagtgcccagg

SEQ ID NO: 697830 - DNA, 25 bp, Rattus norvegicus
ttttgccccaaactgttaattgtca

SEQ ID NO: 697831 - DNA, 25 bp, Rattus norvegicus
ttttgccccaaagtgttaattgtca

SEQ ID NO: 697832 - DNA, 25 bp, Rattus norvegicus
ttttgccccaaattcagtgcccagg

SEQ ID NO: 697833 - DNA, 25 bp, Rattus norvegicus
ttttgccccactactggcatacaaa

SEQ ID NO: 697834 - DNA, 25 bp, Rattus norvegicus
ttttgccccacttctggcatacaaa

SEQ ID NO: 697835 - DNA, 25 bp, Rattus norvegicus
ttttgccccttcaaagatgtcacat

SEQ ID NO: 697836 - DNA, 25 bp, Rattus norvegicus
ttttgccccttctaagatgtcacat

SEQ ID NO: 697837 - DNA, 25 bp, Rattus norvegicus
ttttgcccgttgaccagatccacta

SEQ ID NO: 697838 - DNA, 25 bp, Rattus norvegicus
ttttgcccgttgtccagatccacta

SEQ ID NO: 697839 - DNA, 25 bp, Rattus norvegicus
ttttgccctcaacttcctgatgcaa

SEQ ID NO: 697840 - DNA, 25 bp, Rattus norvegicus
ttttgccctcaagttcctgatgcaa

SEQ ID NO: 697841 - DNA, 25 bp, Rattus norvegicus
ttttgccctggtcactgtagccaag

SEQ ID NO: 697842 - DNA, 25 bp, Rattus norvegicus
ttttgccctggtgactgtagccaag

SEQ ID NO: 697843 - DNA, 25 bp, Rattus norvegicus
ttttgccctgtcacctgaacaaaca

SEQ ID NO: 697844 - DNA, 25 bp, Rattus norvegicus
ttttgccctgtctcctgaacaaaca

SEQ ID NO: 697845 - DNA, 25 bp, Rattus norvegicus
ttttgccctttgcaagagagaacgg

SEQ ID NO: 697846 - DNA, 25 bp, Rattus norvegicus
ttttgccctttggaagagagaacgg

SEQ ID NO: 697847 - DNA, 25 bp, Rattus norvegicus
ttttgccgaatgaagaccacgacca

SEQ ID NO: 697848 - DNA, 25 bp, Rattus norvegicus
ttttgccgaatgtagaccacgacca

SEQ ID NO: 697849 - DNA, 25 bp, Rattus norvegicus
ttttgcctaccccactgagaagcaa

SEQ ID NO: 697850 - DNA, 25 bp, Rattus norvegicus
ttttgcctacccgactgagaagcaa

SEQ ID NO: 697851 - DNA, 25 bp, Rattus norvegicus
ttttgcctagttcatgttgccaagc

SEQ ID NO: 697852 - DNA, 25 bp, Rattus norvegicus
ttttgcctagttgatgttgccaagc

SEQ ID NO: 697853 - DNA, 25 bp, Rattus norvegicus
ttttgcctcacacctgtccagggta

SEQ ID NO: 697854 - DNA, 25 bp, Rattus norvegicus
ttttgcctcacagctgtccagggta

SEQ ID NO: 697855 - DNA, 25 bp, Rattus norvegicus
ttttgcctcatgatgtcacgagcgt

SEQ ID NO: 697856 - DNA, 25 bp, Rattus norvegicus
ttttgcctcatgttgtcacgagcgt

SEQ ID NO: 697857 - DNA, 25 bp, Rattus norvegicus
ttttgcctcattcacttgtactgta

SEQ ID NO: 697858 - DNA, 25 bp, Rattus norvegicus
ttttgcctcattgacttgtactgta

SEQ ID NO: 697859 - DNA, 25 bp, Rattus norvegicus
ttttgcctcgtgagccaaatgcaat

SEQ ID NO: 697860 - DNA, 25 bp, Rattus norvegicus
ttttgcctcgtgtgccaaatgcaat

SEQ ID NO: 697861 - DNA, 25 bp, Rattus norvegicus
ttttgcctctggatgacagtgaaag

SEQ ID NO: 697862 - DNA, 25 bp, Rattus norvegicus
ttttgcctctggttgacagtgaaag

SEQ ID NO: 697863 - DNA, 25 bp, Rattus norvegicus
ttttgcctgccaatgcatttgtgaa

SEQ ID NO: 697864 - DNA, 25 bp, Rattus norvegicus
ttttgcctgccattgcatttgtgaa

SEQ ID NO: 697865 - DNA, 25 bp, Rattus norvegicus
ttttgcctgctgcttgactcagtgg

SEQ ID NO: 697866 - DNA, 25 bp, Rattus norvegicus
ttttgcctgctggttgactcagtgg

SEQ ID NO: 697867 - DNA, 25 bp, Rattus norvegicus
ttttgcctgggtcgcttctatttag

SEQ ID NO: 697868 - DNA, 25 bp, Rattus norvegicus
ttttgcctgggtggcttctatttag

SEQ ID NO: 697869 - DNA, 25 bp, Rattus norvegicus
ttttgcctgtgcattcttaaaactg

SEQ ID NO: 697870 - DNA, 25 bp, Rattus norvegicus
ttttgcctgtgctttcttaaaactg

SEQ ID NO: 697871 - DNA, 25 bp, Rattus norvegicus
ttttgcctgtgtacacgatctctaa

SEQ ID NO: 697872 - DNA, 25 bp, Rattus norvegicus
ttttgcctgtgttcacgatctctaa

SEQ ID NO: 697873 - DNA, 25 bp, Rattus norvegicus
ttttgcctgtttaagacattcctgg

SEQ ID NO: 697874 - DNA, 25 bp, Rattus norvegicus
ttttgcctgttttagacattcctgg

SEQ ID NO: 697875 - DNA, 25 bp, Rattus norvegicus
ttttgccttccacttgtttcccttg

SEQ ID NO: 697876 - DNA, 25 bp, Rattus norvegicus
ttttgccttccagttgtttcccttg

SEQ ID NO: 697877 - DNA, 25 bp, Rattus norvegicus
ttttgccttcgtcagttcctattaa

SEQ ID NO: 697878 - DNA, 25 bp, Rattus norvegicus
ttttgccttcgtgagttcctattaa

SEQ ID NO: 697879 - DNA, 25 bp, Rattus norvegicus
ttttgcctttatattcctaattcag

SEQ ID NO: 697880 - DNA, 25 bp, Rattus norvegicus
ttttgcctttattttcctaattcag

SEQ ID NO: 697881 - DNA, 25 bp, Rattus norvegicus
ttttgcctttcacccagagaagcca

SEQ ID NO: 697882 - DNA, 25 bp, Rattus norvegicus
ttttgcctttcagccagagaagcca

SEQ ID NO: 697883 - DNA, 25 bp, Rattus norvegicus
ttttgcgaccctccttaaaagcagg

SEQ ID NO: 697884 - DNA, 25 bp, Rattus norvegicus
ttttgcgaccctgcttaaaagcagg

SEQ ID NO: 697885 - DNA, 25 bp, Rattus norvegicus
ttttgcgaccgtagccccagtttag

SEQ ID NO: 697886 - DNA, 25 bp, Rattus norvegicus
ttttgcgaccgttgccccagtttag

SEQ ID NO: 697887 - DNA, 25 bp, Rattus norvegicus
ttttgcgattttaccctccaatgaa

SEQ ID NO: 697888 - DNA, 25 bp, Rattus norvegicus
ttttgcgatttttccctccaatgaa

SEQ ID NO: 697889 - DNA, 25 bp, Rattus norvegicus
ttttgcgccaagatcctttcaagaa

SEQ ID NO: 697890 - DNA, 25 bp, Rattus norvegicus
ttttgcgccaagttcctttcaagaa

SEQ ID NO: 697891 - DNA, 25 bp, Rattus norvegicus
ttttgcgctcacctggaagttgtag

SEQ ID NO: 697892 - DNA, 25 bp, Rattus norvegicus
ttttgcgctcacgtggaagttgtag

SEQ ID NO: 697893 - DNA, 25 bp, Rattus norvegicus
ttttgcgctgccattttgtagactt

SEQ ID NO: 697894 - DNA, 25 bp, Rattus norvegicus
ttttgcgctgcctttttgtagactt

SEQ ID NO: 697895 - DNA, 25 bp, Rattus norvegicus
ttttgcggcttcagtttactccaca

SEQ ID NO: 697896 - DNA, 25 bp, Rattus norvegicus
ttttgcggcttctgtttactccaca

SEQ ID NO: 697897 - DNA, 25 bp, Rattus norvegicus
ttttgcgtagcaatgtgtgctgccc

SEQ ID NO: 697898 - DNA, 25 bp, Rattus norvegicus
ttttgcgtagcattgtgtgctgccc

SEQ ID NO: 697899 - DNA, 25 bp, Rattus norvegicus
ttttgcgttgcccatttttctccaa

SEQ ID NO: 697900 - DNA, 25 bp, Rattus norvegicus
ttttgcgttgccgatttttctccaa

SEQ ID NO: 697901 - DNA, 25 bp, Rattus norvegicus
ttttgctaagcactggttcctccag

SEQ ID NO: 697902 - DNA, 25 bp, Rattus norvegicus
ttttgctaagcagtggttcctccag

SEQ ID NO: 697903 - DNA, 25 bp, Rattus norvegicus
ttttgctacagtagttcatgaccaa

SEQ ID NO: 697904 - DNA, 25 bp, Rattus norvegicus
ttttgctacagttgttcatgaccaa

SEQ ID NO: 697905 - DNA, 25 bp, Rattus norvegicus
ttttgctaccaaaagtcttctccac

SEQ ID NO: 697906 - DNA, 25 bp, Rattus norvegicus
ttttgctaccaatagtcttctccac

SEQ ID NO: 697907 - DNA, 25 bp, Rattus norvegicus
ttttgctcatgtctctgctccttac

SEQ ID NO: 697908 - DNA, 25 bp, Rattus norvegicus
ttttgctcatgtgtctgctccttac

SEQ ID NO: 697909 - DNA, 25 bp, Rattus norvegicus
ttttgctcatttccccttatactcg

SEQ ID NO: 697910 - DNA, 25 bp, Rattus norvegicus
ttttgctcatttgcccttatactcg

SEQ ID NO: 697911 - DNA, 25 bp, Rattus norvegicus
ttttgctccagaatttcgaaggcca

SEQ ID NO: 697912 - DNA, 25 bp, Rattus norvegicus
ttttgctccagattttcgaaggcca

SEQ ID NO: 697913 - DNA, 25 bp, Rattus norvegicus
ttttgctccagcattttcttctcat

SEQ ID NO: 697914 - DNA, 25 bp, Rattus norvegicus
ttttgctccagctttttcttctcat

SEQ ID NO: 697915 - DNA, 25 bp, Rattus norvegicus
ttttgctccccgctgaaggtaatgg

SEQ ID NO: 697916 - DNA, 25 bp, Rattus norvegicus
ttttgctccccggtgaaggtaatgg

SEQ ID NO: 697917 - DNA, 25 bp, Rattus norvegicus
ttttgctccctaaaatagatggcat

SEQ ID NO: 697918 - DNA, 25 bp, Rattus norvegicus
ttttgctccctataatagatggcat

SEQ ID NO: 697919 - DNA, 25 bp, Rattus norvegicus
ttttgctcccttcttattctttagt

SEQ ID NO: 697920 - DNA, 25 bp, Rattus norvegicus
ttttgctcccttgttattctttagt

SEQ ID NO: 697921 - DNA, 25 bp, Rattus norvegicus
ttttgctctgttactacttctgcct

SEQ ID NO: 697922 - DNA, 25 bp, Rattus norvegicus
ttttgctctgtttctacttctgcct

SEQ ID NO: 697923 - DNA, 25 bp, Rattus norvegicus
ttttgctctttaaaaccgtctcaga

SEQ ID NO: 697924 - DNA, 25 bp, Rattus norvegicus
ttttgctctttataaccgtctcaga

SEQ ID NO: 697925 - DNA, 25 bp, Rattus norvegicus
ttttgctgaaaaacccaccctgaag

SEQ ID NO: 697926 - DNA, 25 bp, Rattus norvegicus
ttttgctgaaaatcccaccctgaag

SEQ ID NO: 697927 - DNA, 25 bp, Rattus norvegicus
ttttgctgcagtaacattaatgtct

SEQ ID NO: 697928 - DNA, 25 bp, Rattus norvegicus
ttttgctgcagttacattaatgtct

SEQ ID NO: 697929 - DNA, 25 bp, Rattus norvegicus
ttttgctgctaaagaatctcccctc

SEQ ID NO: 697930 - DNA, 25 bp, Rattus norvegicus
ttttgctgctaatgaatctcccctc

SEQ ID NO: 697931 - DNA, 25 bp, Rattus norvegicus
ttttgctgctacatcatttgttctg

SEQ ID NO: 697932 - DNA, 25 bp, Rattus norvegicus
ttttgctgctacttcatttgttctg

SEQ ID NO: 697933 - DNA, 25 bp, Rattus norvegicus
ttttgctggcccagggagcactgat

SEQ ID NO: 697934 - DNA, 25 bp, Rattus norvegicus
ttttgctggccctgggagcactgat

SEQ ID NO: 697935 - DNA, 25 bp, Rattus norvegicus
ttttgctggtgaaaagtggctcctt

SEQ ID NO: 697936 - DNA, 25 bp, Rattus norvegicus
ttttgctggtgataagtggctcctt

SEQ ID NO: 697937 - DNA, 25 bp, Rattus norvegicus
ttttgctgtagaagtttggatccac

SEQ ID NO: 697938 - DNA, 25 bp, Rattus norvegicus
ttttgctgtagatgtttggatccac

SEQ ID NO: 697939 - DNA, 25 bp, Rattus norvegicus
ttttgctgtcaaaagctctgtaacc

SEQ ID NO: 697940 - DNA, 25 bp, Rattus norvegicus
ttttgctgtcaatagctctgtaacc

SEQ ID NO: 697941 - DNA, 25 bp, Rattus norvegicus
ttttgctgtcccactactaatgtga

SEQ ID NO: 697942 - DNA, 25 bp, Rattus norvegicus
ttttgctgtccctctactaatgtga

SEQ ID NO: 697943 - DNA, 25 bp, Rattus norvegicus
ttttgctgttatccctgtcgtgact

SEQ ID NO: 697944 - DNA, 25 bp, Rattus norvegicus
ttttgctgttatgcctgtcgtgact

SEQ ID NO: 697945 - DNA, 25 bp, Rattus norvegicus
ttttgctgtttcacttgtatgtaaa

SEQ ID NO: 697946 - DNA, 25 bp, Rattus norvegicus
ttttgctgtttctcttgtatgtaaa

SEQ ID NO: 697947 - DNA, 25 bp, Rattus norvegicus
ttttgcttaaaccatgagtcaccat

SEQ ID NO: 697948 - DNA, 25 bp, Rattus norvegicus
ttttgcttaaacgatgagtcaccat

SEQ ID NO: 697949 - DNA, 25 bp, Rattus norvegicus
ttttgcttcgaaatggactgctcta

SEQ ID NO: 697950 - DNA, 25 bp, Rattus norvegicus
ttttgcttcgaattggactgctcta

SEQ ID NO: 697951 - DNA, 25 bp, Rattus norvegicus
ttttgcttgatgagccatgcaggaa

SEQ ID NO: 697952 - DNA, 25 bp, Rattus norvegicus
ttttgcttgatgtgccatgcaggaa

SEQ ID NO: 697953 - DNA, 25 bp, Rattus norvegicus
ttttgcttggcccttatctactaat

SEQ ID NO: 697954 - DNA, 25 bp, Rattus norvegicus
ttttgcttggccgttatctactaat

SEQ ID NO: 697955 - DNA, 25 bp, Rattus norvegicus
ttttgcttttggctgacctcactgc

SEQ ID NO: 697956 - DNA, 25 bp, Rattus norvegicus
ttttgcttttgggtgacctcactgc

SEQ ID NO: 697957 - DNA, 25 bp, Rattus norvegicus
ttttgcttttgtctgaatttgtctc

SEQ ID NO: 697958 - DNA, 25 bp, Rattus norvegicus
ttttgcttttgtgtgaatttgtctc

SEQ ID NO: 697959 - DNA, 25 bp, Rattus norvegicus
ttttggaaaagtcagccccatctct

SEQ ID NO: 697960 - DNA, 25 bp, Rattus norvegicus
ttttggaaaagtgagccccatctct

SEQ ID NO: 697961 - DNA, 25 bp, Rattus norvegicus
ttttggaagaccaggctttccagat

SEQ ID NO: 697962 - DNA, 25 bp, Rattus norvegicus
ttttggaagacctggctttccagat

SEQ ID NO: 697963 - DNA, 25 bp, Rattus norvegicus
ttttggaagttacccattcatgagt

SEQ ID NO: 697964 - DNA, 25 bp, Rattus norvegicus
ttttggaagttagccattcatgagt

SEQ ID NO: 697965 - DNA, 25 bp, Rattus norvegicus
ttttggaatgcccacttggagctct

SEQ ID NO: 697966 - DNA, 25 bp, Rattus norvegicus
ttttggaatgccgacttggagctct

SEQ ID NO: 697967 - DNA, 25 bp, Rattus norvegicus
ttttggaatgctagatcttggactt

SEQ ID NO: 697968 - DNA, 25 bp, Rattus norvegicus
ttttggaatgcttgatcttggactt

SEQ ID NO: 697969 - DNA, 25 bp, Rattus norvegicus
ttttggaccaccacaggcatgtttc

SEQ ID NO: 697970 - DNA, 25 bp, Rattus norvegicus
ttttggaccacctcaggcatgtttc

SEQ ID NO: 697971 - DNA, 25 bp, Rattus norvegicus
ttttggacccgcatatactatattc

SEQ ID NO: 697972 - DNA, 25 bp, Rattus norvegicus
ttttggacccgcttatactatattc

SEQ ID NO: 697973 - DNA, 25 bp, Rattus norvegicus
ttttggaccgcacgaaaggacagtt

SEQ ID NO: 697974 - DNA, 25 bp, Rattus norvegicus
ttttggaccgcaggaaaggacagtt

SEQ ID NO: 697975 - DNA, 25 bp, Rattus norvegicus
ttttggaccttgctctctagagatc

SEQ ID NO: 697976 - DNA, 25 bp, Rattus norvegicus
ttttggaccttggtctctagagatc

SEQ ID NO: 697977 - DNA, 25 bp, Rattus norvegicus
ttttggacgaagcagtgaggcccct

SEQ ID NO: 697978 - DNA, 25 bp, Rattus norvegicus
ttttggacgaaggagtgaggcccct

SEQ ID NO: 697979 - DNA, 25 bp, Rattus norvegicus
ttttggacttggagaccgccaccct

SEQ ID NO: 697980 - DNA, 25 bp, Rattus norvegicus
ttttggacttggtgaccgccaccct

SEQ ID NO: 697981 - DNA, 25 bp, Rattus norvegicus
ttttggacttttctctcatgctcct

SEQ ID NO: 697982 - DNA, 25 bp, Rattus norvegicus
ttttggacttttgtctcatgctcct

SEQ ID NO: 697983 - DNA, 25 bp, Rattus norvegicus
ttttggaggccaacagtgaccctgc

SEQ ID NO: 697984 - DNA, 25 bp, Rattus norvegicus
ttttggaggccatcagtgaccctgc

SEQ ID NO: 697985 - DNA, 25 bp, Rattus norvegicus
ttttggatctctctcgagtcggttc

SEQ ID NO: 697986 - DNA, 25 bp, Rattus norvegicus
ttttggatctctgtcgagtcggttc

SEQ ID NO: 697987 - DNA, 25 bp, Rattus norvegicus
ttttggatctgactgatgccatcga

SEQ ID NO: 697988 - DNA, 25 bp, Rattus norvegicus
ttttggatctgagtgatgccatcga

SEQ ID NO: 697989 - DNA, 25 bp, Rattus norvegicus
ttttggatgactctggtctgtgctc

SEQ ID NO: 697990 - DNA, 25 bp, Rattus norvegicus
ttttggatgactgtggtctgtgctc

SEQ ID NO: 697991 - DNA, 25 bp, Rattus norvegicus
ttttggatgagccatttaacagcca

SEQ ID NO: 697992 - DNA, 25 bp, Rattus norvegicus
ttttggatgagcgatttaacagcca

SEQ ID NO: 697993 - DNA, 25 bp, Rattus norvegicus
ttttggatgctgcatcttctaccgt

SEQ ID NO: 697994 - DNA, 25 bp, Rattus norvegicus
ttttggatgctggatcttctaccgt

SEQ ID NO: 697995 - DNA, 25 bp, Rattus norvegicus
ttttggattggtagccctttcactc

SEQ ID NO: 697996 - DNA, 25 bp, Rattus norvegicus
ttttggattggttgccctttcactc

SEQ ID NO: 697997 - DNA, 25 bp, Rattus norvegicus
ttttggattgtgatcttgccttcct

SEQ ID NO: 697998 - DNA, 25 bp, Rattus norvegicus
ttttggattgtgttcttgccttcct

SEQ ID NO: 697999 - DNA, 25 bp, Rattus norvegicus
ttttggcaaaatacttcccttcact

SEQ ID NO: 698000 - DNA, 25 bp, Rattus norvegicus
ttttggcaaaattcttcccttcact

SEQ ID NO: 698001 - DNA, 25 bp, Rattus norvegicus
ttttggcaagggaagtcactagcga

SEQ ID NO: 698002 - DNA, 25 bp, Rattus norvegicus
ttttggcaagggtagtcactagcga

SEQ ID NO: 698003 - DNA, 25 bp, Rattus norvegicus
ttttggcactgcctttggtctggag

SEQ ID NO: 698004 - DNA, 25 bp, Rattus norvegicus
ttttggcactgcgtttggtctggag

SEQ ID NO: 698005 - DNA, 25 bp, Rattus norvegicus
ttttggcagatcacattctgaggct

SEQ ID NO: 698006 - DNA, 25 bp, Rattus norvegicus
ttttggcagatctcattctgaggct

SEQ ID NO: 698007 - DNA, 25 bp, Rattus norvegicus
ttttggcagggaagacggattttca

SEQ ID NO: 698008 - DNA, 25 bp, Rattus norvegicus
ttttggcagggacattaccgaggaa

SEQ ID NO: 698009 - DNA, 25 bp, Rattus norvegicus
ttttggcagggagattaccgaggaa

SEQ ID NO: 698010 - DNA, 25 bp, Rattus norvegicus
ttttggcagggatgacggattttca

SEQ ID NO: 698011 - DNA, 25 bp, Rattus norvegicus
ttttggcattaccatccatagcctc

SEQ ID NO: 698012 - DNA, 25 bp, Rattus norvegicus
ttttggcattacgatccatagcctc

SEQ ID NO: 698013 - DNA, 25 bp, Rattus norvegicus
ttttggccacctctgatcattggtt

SEQ ID NO: 698014 - DNA, 25 bp, Rattus norvegicus
ttttggccacctgtgatcattggtt

SEQ ID NO: 698015 - DNA, 25 bp, Rattus norvegicus
ttttggccagctcttcgtgaggata

SEQ ID NO: 698016 - DNA, 25 bp, Rattus norvegicus
ttttggccagctgttcgtgaggata

SEQ ID NO: 698017 - DNA, 25 bp, Rattus norvegicus
ttttggcccaccaggatttccctca

SEQ ID NO: 698018 - DNA, 25 bp, Rattus norvegicus
ttttggcccacctggatttccctca

SEQ ID NO: 698019 - DNA, 25 bp, Rattus norvegicus
ttttggccgtcaccgatgggtcata

SEQ ID NO: 698020 - DNA, 25 bp, Rattus norvegicus
ttttggccgtcagcgatgggtcata

SEQ ID NO: 698021 - DNA, 25 bp, Rattus norvegicus
ttttggccgtctattctaaatatca

SEQ ID NO: 698022 - DNA, 25 bp, Rattus norvegicus
ttttggccgtcttttctaaatatca

SEQ ID NO: 698023 - DNA, 25 bp, Rattus norvegicus
ttttggcctgaacagaccgttgctg

SEQ ID NO: 698024 - DNA, 25 bp, Rattus norvegicus
ttttggcctgaagagaccgttgctg

SEQ ID NO: 698025 - DNA, 25 bp, Rattus norvegicus
ttttggcctggcaatttctcccaca

SEQ ID NO: 698026 - DNA, 25 bp, Rattus norvegicus
ttttggcctggctatttctcccaca

SEQ ID NO: 698027 - DNA, 25 bp, Rattus norvegicus
ttttggcgacgtacgatggtaactc

SEQ ID NO: 698028 - DNA, 25 bp, Rattus norvegicus
ttttggcgacgttcgatggtaactc

SEQ ID NO: 698029 - DNA, 25 bp, Rattus norvegicus
ttttggcgtacactagagaccgttt

SEQ ID NO: 698030 - DNA, 25 bp, Rattus norvegicus
ttttggcgtacagtagagaccgttt

SEQ ID NO: 698031 - DNA, 25 bp, Rattus norvegicus
ttttggctataacttcggacactac

SEQ ID NO: 698032 - DNA, 25 bp, Rattus norvegicus
ttttggctataagttcggacactac

SEQ ID NO: 698033 - DNA, 25 bp, Rattus norvegicus
ttttggctatttctacctcacacga

SEQ ID NO: 698034 - DNA, 25 bp, Rattus norvegicus
ttttggctatttgtacctcacacga

SEQ ID NO: 698035 - DNA, 25 bp, Rattus norvegicus
ttttggctccaaccatcccataaaa

SEQ ID NO: 698036 - DNA, 25 bp, Rattus norvegicus
ttttggctccaagcatcccataaaa

SEQ ID NO: 698037 - DNA, 25 bp, Rattus norvegicus
ttttggctcctacagcaggaggcct

SEQ ID NO: 698038 - DNA, 25 bp, Rattus norvegicus
ttttggctcctagagcaggaggcct

SEQ ID NO: 698039 - DNA, 25 bp, Rattus norvegicus
ttttggctcctcaaactgaacagct

SEQ ID NO: 698040 - DNA, 25 bp, Rattus norvegicus
ttttggctcctctaactgaacagct

SEQ ID NO: 698041 - DNA, 25 bp, Rattus norvegicus
ttttggctctccatttccaagcgaa

SEQ ID NO: 698042 - DNA, 25 bp, Rattus norvegicus
ttttggctctccttttccaagcgaa

SEQ ID NO: 698043 - DNA, 25 bp, Rattus norvegicus
ttttggctgttgacagtggctcgct

SEQ ID NO: 698044 - DNA, 25 bp, Rattus norvegicus
ttttggctgttgtcagtggctcgct

SEQ ID NO: 698045 - DNA, 25 bp, Rattus norvegicus
ttttggcttataatctcgtgggcta

SEQ ID NO: 698046 - DNA, 25 bp, Rattus norvegicus
ttttggcttatattctcgtgggcta

SEQ ID NO: 698047 - DNA, 25 bp, Rattus norvegicus
ttttggcttcatatctttttcatag

SEQ ID NO: 698048 - DNA, 25 bp, Rattus norvegicus
ttttggcttcatttctttttcatag

SEQ ID NO: 698049 - DNA, 25 bp, Rattus norvegicus
ttttggcttcgacatcctgttttct

SEQ ID NO: 698050 - DNA, 25 bp, Rattus norvegicus
ttttggcttcgagatcctgttttct

SEQ ID NO: 698051 - DNA, 25 bp, Rattus norvegicus
ttttggcttgctatccgaagaggaa

SEQ ID NO: 698052 - DNA, 25 bp, Rattus norvegicus
ttttggcttgctttccgaagaggaa

SEQ ID NO: 698053 - DNA, 25 bp, Rattus norvegicus
ttttggcttgttacgtccttcagac

SEQ ID NO: 698054 - DNA, 25 bp, Rattus norvegicus
ttttggcttgtttcgtccttcagac

SEQ ID NO: 698055 - DNA, 25 bp, Rattus norvegicus
ttttggctttctagggtatctgcac

SEQ ID NO: 698056 - DNA, 25 bp, Rattus norvegicus
ttttggctttcttgggtatctgcac

SEQ ID NO: 698057 - DNA, 25 bp, Rattus norvegicus
ttttgggaacacaccagactggaat

SEQ ID NO: 698058 - DNA, 25 bp, Rattus norvegicus
ttttgggaacactccagactggaat

SEQ ID NO: 698059 - DNA, 25 bp, Rattus norvegicus
ttttgggacaagctctcgctccata

SEQ ID NO: 698060 - DNA, 25 bp, Rattus norvegicus
ttttgggacaaggtctcgctccata

SEQ ID NO: 698061 - DNA, 25 bp, Rattus norvegicus
ttttgggacaatcgcatcgtgacac

SEQ ID NO: 698062 - DNA, 25 bp, Rattus norvegicus
ttttgggacaatggcatcgtgacac

SEQ ID NO: 698063 - DNA, 25 bp, Rattus norvegicus
ttttgggagacgaccgtgcaactct

SEQ ID NO: 698064 - DNA, 25 bp, Rattus norvegicus
ttttgggagacgtccgtgcaactct

SEQ ID NO: 698065 - DNA, 25 bp, Rattus norvegicus
ttttgggagatgacgcgcgagaccc

SEQ ID NO: 698066 - DNA, 25 bp, Rattus norvegicus
ttttgggagatgtcgcgcgagaccc

SEQ ID NO: 698067 - DNA, 25 bp, Rattus norvegicus
ttttgggagcccaggaaccacacaa

SEQ ID NO: 698068 - DNA, 25 bp, Rattus norvegicus
ttttgggagccctggaaccacacaa

SEQ ID NO: 698069 - DNA, 25 bp, Rattus norvegicus
ttttgggagctgcttttcttcttca

SEQ ID NO: 698070 - DNA, 25 bp, Rattus norvegicus
ttttgggagctggttttcttcttca

SEQ ID NO: 698071 - DNA, 25 bp, Rattus norvegicus
ttttgggcagtaatgcagtctcacc

SEQ ID NO: 698072 - DNA, 25 bp, Rattus norvegicus
ttttgggcagtattgcagtctcacc

SEQ ID NO: 698073 - DNA, 25 bp, Rattus norvegicus
ttttgggccaagctaaactgtaagt

SEQ ID NO: 698074 - DNA, 25 bp, Rattus norvegicus
ttttgggccaaggtaaactgtaagt

SEQ ID NO: 698075 - DNA, 25 bp, Rattus norvegicus
ttttgggccagtattggaccagagc

SEQ ID NO: 698076 - DNA, 25 bp, Rattus norvegicus
ttttgggccagttttggaccagagc

SEQ ID NO: 698077 - DNA, 25 bp, Rattus norvegicus
ttttggggccgccatacttgcccgg

SEQ ID NO: 698078 - DNA, 25 bp, Rattus norvegicus
ttttggggccgcgatacttgcccgg

SEQ ID NO: 698079 - DNA, 25 bp, Rattus norvegicus
ttttgggtcactcgtgctgatttcc

SEQ ID NO: 698080 - DNA, 25 bp, Rattus norvegicus
ttttgggtcactggtgctgatttcc

SEQ ID NO: 698081 - DNA, 25 bp, Rattus norvegicus
ttttgggttcatatcctgatatgac

SEQ ID NO: 698082 - DNA, 25 bp, Rattus norvegicus
ttttgggttcatttcctgatatgac

SEQ ID NO: 698083 - DNA, 25 bp, Rattus norvegicus
ttttggtaacgactacaggctcagt

SEQ ID NO: 698084 - DNA, 25 bp, Rattus norvegicus
ttttggtaacgagtacaggctcagt

SEQ ID NO: 698085 - DNA, 25 bp, Rattus norvegicus
ttttggtaattaactccctctgcct

SEQ ID NO: 698086 - DNA, 25 bp, Rattus norvegicus
ttttggtaattatctccctctgcct

SEQ ID NO: 698087 - DNA, 25 bp, Rattus norvegicus
ttttggtacaatatcctgtcccagg

SEQ ID NO: 698088 - DNA, 25 bp, Rattus norvegicus
ttttggtacaatttcctgtcccagg

SEQ ID NO: 698089 - DNA, 25 bp, Rattus norvegicus
ttttggtatcctctacattgcagtg

SEQ ID NO: 698090 - DNA, 25 bp, Rattus norvegicus
ttttggtatcctgtacattgcagtg

SEQ ID NO: 698091 - DNA, 25 bp, Rattus norvegicus
ttttggtcaagccttattctgtatt

SEQ ID NO: 698092 - DNA, 25 bp, Rattus norvegicus
ttttggtcaagcgttattctgtatt

SEQ ID NO: 698093 - DNA, 25 bp, Rattus norvegicus
ttttggtcactccatgggaggtcac

SEQ ID NO: 698094 - DNA, 25 bp, Rattus norvegicus
ttttggtcactcgatgggaggtcac

SEQ ID NO: 698095 - DNA, 25 bp, Rattus norvegicus
ttttggtccaggatttggtccacca

SEQ ID NO: 698096 - DNA, 25 bp, Rattus norvegicus
ttttggtccaggttttggtccacca

SEQ ID NO: 698097 - DNA, 25 bp, Rattus norvegicus
ttttggtcccgcagaaacttggcag

SEQ ID NO: 698098 - DNA, 25 bp, Rattus norvegicus
ttttggtcccgctgaaacttggcag

SEQ ID NO: 698099 - DNA, 25 bp, Rattus norvegicus
ttttggtccgggatgactccagggc

SEQ ID NO: 698100 - DNA, 25 bp, Rattus norvegicus
ttttggtccgggttgactccagggc

SEQ ID NO: 698101 - DNA, 25 bp, Rattus norvegicus
ttttggtcggagactgtggctccca

SEQ ID NO: 698102 - DNA, 25 bp, Rattus norvegicus
ttttggtcggagtctgtggctccca

SEQ ID NO: 698103 - DNA, 25 bp, Rattus norvegicus
ttttggtctccgatttgttctcatc

SEQ ID NO: 698104 - DNA, 25 bp, Rattus norvegicus
ttttggtctccgttttgttctcatc

SEQ ID NO: 698105 - DNA, 25 bp, Rattus norvegicus
ttttggtctctgcatcccgggataa

SEQ ID NO: 698106 - DNA, 25 bp, Rattus norvegicus
ttttggtctctggatcccgggataa

SEQ ID NO: 698107 - DNA, 25 bp, Rattus norvegicus
ttttggtcttgccttggttcagcat

SEQ ID NO: 698108 - DNA, 25 bp, Rattus norvegicus
ttttggtcttgcgttggttcagcat

SEQ ID NO: 698109 - DNA, 25 bp, Rattus norvegicus
ttttggtgactaacttgccttatcc

SEQ ID NO: 698110 - DNA, 25 bp, Rattus norvegicus
ttttggtgactatcttgccttatcc

SEQ ID NO: 698111 - DNA, 25 bp, Rattus norvegicus
ttttggtgatggaacagggctcctt

SEQ ID NO: 698112 - DNA, 25 bp, Rattus norvegicus
ttttggtgatggtacagggctcctt

SEQ ID NO: 698113 - DNA, 25 bp, Rattus norvegicus
ttttggtggtacctgtagtcgtctc

SEQ ID NO: 698114 - DNA, 25 bp, Rattus norvegicus
ttttggtggtacgtgtagtcgtctc

SEQ ID NO: 698115 - DNA, 25 bp, Rattus norvegicus
ttttggttccggaccatgtgatcac

SEQ ID NO: 698116 - DNA, 25 bp, Rattus norvegicus
ttttggttccggtccatgtgatcac

SEQ ID NO: 698117 - DNA, 25 bp, Rattus norvegicus
ttttggttgtccacaagaaaagaag

SEQ ID NO: 698118 - DNA, 25 bp, Rattus norvegicus
ttttggttgtcctcaagaaaagaag

SEQ ID NO: 698119 - DNA, 25 bp, Rattus norvegicus
ttttggtttggtactcgtgtctctc

SEQ ID NO: 698120 - DNA, 25 bp, Rattus norvegicus
ttttggtttggttctcgtgtctctc

SEQ ID NO: 698121 - DNA, 25 bp, Rattus norvegicus
ttttggtttgtgacagtgtcccctc

SEQ ID NO: 698122 - DNA, 25 bp, Rattus norvegicus
ttttggtttgtgtcagtgtcccctc

SEQ ID NO: 698123 - DNA, 25 bp, Rattus norvegicus
ttttggttttccaagacagtctcat

SEQ ID NO: 698124 - DNA, 25 bp, Rattus norvegicus
ttttggttttcctagacagtctcat

SEQ ID NO: 698125 - DNA, 25 bp, Rattus norvegicus
ttttggttttgcactgattcttgcc

SEQ ID NO: 698126 - DNA, 25 bp, Rattus norvegicus
ttttggttttgctctgattcttgcc

SEQ ID NO: 698127 - DNA, 25 bp, Rattus norvegicus
ttttgtaaacaaaggccactggcct

SEQ ID NO: 698128 - DNA, 25 bp, Rattus norvegicus
ttttgtaaacaatggccactggcct

SEQ ID NO: 698129 - DNA, 25 bp, Rattus norvegicus
ttttgtaaagcaagcagcctccctc

SEQ ID NO: 698130 - DNA, 25 bp, Rattus norvegicus
ttttgtaaagcatgcagcctccctc

SEQ ID NO: 698131 - DNA, 25 bp, Rattus norvegicus
ttttgtaaagctacccacattcctt

SEQ ID NO: 698132 - DNA, 25 bp, Rattus norvegicus
ttttgtaaagcttcccacattcctt

SEQ ID NO: 698133 - DNA, 25 bp, Rattus norvegicus
ttttgtaaagttcactggctctgca

SEQ ID NO: 698134 - DNA, 25 bp, Rattus norvegicus
ttttgtaaagttgactggctctgca

SEQ ID NO: 698135 - DNA, 25 bp, Rattus norvegicus
ttttgtaacagtaaccacgctcgca

SEQ ID NO: 698136 - DNA, 25 bp, Rattus norvegicus
ttttgtaacagttaccacgctcgca

SEQ ID NO: 698137 - DNA, 25 bp, Rattus norvegicus
ttttgtaacatccttaacagtgcct

SEQ ID NO: 698138 - DNA, 25 bp, Rattus norvegicus
ttttgtaacatcgttaacagtgcct

SEQ ID NO: 698139 - DNA, 25 bp, Rattus norvegicus
ttttgtaagacgaccctgcagtcca

SEQ ID NO: 698140 - DNA, 25 bp, Rattus norvegicus
ttttgtaagacgtccctgcagtcca

SEQ ID NO: 698141 - DNA, 25 bp, Rattus norvegicus
ttttgtaagcccacccagtgaaaat

SEQ ID NO: 698142 - DNA, 25 bp, Rattus norvegicus
ttttgtaagccctcccagtgaaaat

SEQ ID NO: 698143 - DNA, 25 bp, Rattus norvegicus
ttttgtaatctcagatgcctcaccc

SEQ ID NO: 698144 - DNA, 25 bp, Rattus norvegicus
ttttgtaatctctgatgcctcaccc

SEQ ID NO: 698145 - DNA, 25 bp, Rattus norvegicus
ttttgtacagtaatttctcctcctc

SEQ ID NO: 698146 - DNA, 25 bp, Rattus norvegicus
ttttgtacagtattttctcctcctc

SEQ ID NO: 698147 - DNA, 25 bp, Rattus norvegicus
ttttgtacattgacctcgttcgcga

SEQ ID NO: 698148 - DNA, 25 bp, Rattus norvegicus
ttttgtacattgtcctcgttcgcga

SEQ ID NO: 698149 - DNA, 25 bp, Rattus norvegicus
ttttgtaccaaactggctcgaagtg

SEQ ID NO: 698150 - DNA, 25 bp, Rattus norvegicus
ttttgtaccaaagtggctcgaagtg

SEQ ID NO: 698151 - DNA, 25 bp, Rattus norvegicus
ttttgtacctttctctgtgggatgg

SEQ ID NO: 698152 - DNA, 25 bp, Rattus norvegicus
ttttgtacctttgtctgtgggatgg

SEQ ID NO: 698153 - DNA, 25 bp, Rattus norvegicus
ttttgtacgaccctccattggccct

SEQ ID NO: 698154 - DNA, 25 bp, Rattus norvegicus
ttttgtacgaccgtccattggccct

SEQ ID NO: 698155 - DNA, 25 bp, Rattus norvegicus
ttttgtacgtgtactaattcactga

SEQ ID NO: 698156 - DNA, 25 bp, Rattus norvegicus
ttttgtacgtgttctaattcactga

SEQ ID NO: 698157 - DNA, 25 bp, Rattus norvegicus
ttttgtactaaacctcattcagtta

SEQ ID NO: 698158 - DNA, 25 bp, Rattus norvegicus
ttttgtactaaagctcattcagtta

SEQ ID NO: 698159 - DNA, 25 bp, Rattus norvegicus
ttttgtactaatacatcctccgcta

SEQ ID NO: 698160 - DNA, 25 bp, Rattus norvegicus
ttttgtactaattcatcctccgcta

SEQ ID NO: 698161 - DNA, 25 bp, Rattus norvegicus
ttttgtactacacggcatgggtttg

SEQ ID NO: 698162 - DNA, 25 bp, Rattus norvegicus
ttttgtactacagggcatgggtttg

SEQ ID NO: 698163 - DNA, 25 bp, Rattus norvegicus
ttttgtactcgtaactggctccaca

SEQ ID NO: 698164 - DNA, 25 bp, Rattus norvegicus
ttttgtactcgttactggctccaca

SEQ ID NO: 698165 - DNA, 25 bp, Rattus norvegicus
ttttgtagagctcgacaattgagtc

SEQ ID NO: 698166 - DNA, 25 bp, Rattus norvegicus
ttttgtagagctggacaattgagtc

SEQ ID NO: 698167 - DNA, 25 bp, Rattus norvegicus
ttttgtagccccaaaatactgatga

SEQ ID NO: 698168 - DNA, 25 bp, Rattus norvegicus
ttttgtagcccctaaatactgatga

SEQ ID NO: 698169 - DNA, 25 bp, Rattus norvegicus
ttttgtagctctcagcccgggtcaa

SEQ ID NO: 698170 - DNA, 25 bp, Rattus norvegicus
ttttgtagctctgagcccgggtcaa

SEQ ID NO: 698171 - DNA, 25 bp, Rattus norvegicus
ttttgtagtaacagtccatcgtgga

SEQ ID NO: 698172 - DNA, 25 bp, Rattus norvegicus
ttttgtagtaactgtccatcgtgga

SEQ ID NO: 698173 - DNA, 25 bp, Rattus norvegicus
ttttgtagtacacgccagtctccat

SEQ ID NO: 698174 - DNA, 25 bp, Rattus norvegicus
ttttgtagtacaggccagtctccat

SEQ ID NO: 698175 - DNA, 25 bp, Rattus norvegicus
ttttgtagttttcgccatcattgga

SEQ ID NO: 698176 - DNA, 25 bp, Rattus norvegicus
ttttgtagttttggccatcattgga

SEQ ID NO: 698177 - DNA, 25 bp, Rattus norvegicus
ttttgtataagaatgtggctcctag

SEQ ID NO: 698178 - DNA, 25 bp, Rattus norvegicus
ttttgtataagattgtggctcctag

SEQ ID NO: 698179 - DNA, 25 bp, Rattus norvegicus
ttttgtatcaatagtgaccaccatg

SEQ ID NO: 698180 - DNA, 25 bp, Rattus norvegicus
ttttgtatcaattgtgaccaccatg

SEQ ID NO: 698181 - DNA, 25 bp, Rattus norvegicus
ttttgtatgtgtctccgcatgtgtg

SEQ ID NO: 698182 - DNA, 25 bp, Rattus norvegicus
ttttgtatgtgtgtccgcatgtgtg

SEQ ID NO: 698183 - DNA, 25 bp, Rattus norvegicus
ttttgtattacccatcacctagcac

SEQ ID NO: 698184 - DNA, 25 bp, Rattus norvegicus
ttttgtattaccgatcacctagcac

SEQ ID NO: 698185 - DNA, 25 bp, Rattus norvegicus
ttttgtattagcaaactcctaactg

SEQ ID NO: 698186 - DNA, 25 bp, Rattus norvegicus
ttttgtattagctaactcctaactg

SEQ ID NO: 698187 - DNA, 25 bp, Rattus norvegicus
ttttgtattataaccatcctccctc

SEQ ID NO: 698188 - DNA, 25 bp, Rattus norvegicus
ttttgtattatatccatcctccctc

SEQ ID NO: 698189 - DNA, 25 bp, Rattus norvegicus
ttttgtattcctaatattcctcaag

SEQ ID NO: 698190 - DNA, 25 bp, Rattus norvegicus
ttttgtattccttatattcctcaag

SEQ ID NO: 698191 - DNA, 25 bp, Rattus norvegicus
ttttgtatttaaagccctggtcctt

SEQ ID NO: 698192 - DNA, 25 bp, Rattus norvegicus
ttttgtatttaatgccctggtcctt

SEQ ID NO: 698193 - DNA, 25 bp, Rattus norvegicus
ttttgtcaaggcagatcatctttgt

SEQ ID NO: 698194 - DNA, 25 bp, Rattus norvegicus
ttttgtcaaggctgatcatctttgt

SEQ ID NO: 698195 - DNA, 25 bp, Rattus norvegicus
ttttgtcacctcctgtaccttccag

SEQ ID NO: 698196 - DNA, 25 bp, Rattus norvegicus
ttttgtcacctcgtgtaccttccag

SEQ ID NO: 698197 - DNA, 25 bp, Rattus norvegicus
ttttgtcagcaaccaaactggcaga

SEQ ID NO: 698198 - DNA, 25 bp, Rattus norvegicus
ttttgtcagcaacgcctgttctgca

SEQ ID NO: 698199 - DNA, 25 bp, Rattus norvegicus
ttttgtcagcaagcaaactggcaga

SEQ ID NO: 698200 - DNA, 25 bp, Rattus norvegicus
ttttgtcagcaaggcctgttctgca

SEQ ID NO: 698201 - DNA, 25 bp, Rattus norvegicus
ttttgtcatatgctcctaacaatgg

SEQ ID NO: 698202 - DNA, 25 bp, Rattus norvegicus
ttttgtcatatggtcctaacaatgg

SEQ ID NO: 698203 - DNA, 25 bp, Rattus norvegicus
ttttgtcatgttaccctaacttact

SEQ ID NO: 698204 - DNA, 25 bp, Rattus norvegicus
ttttgtcatgtttccctaacttact

SEQ ID NO: 698205 - DNA, 25 bp, Rattus norvegicus
ttttgtcattcacttatgtttttgc

SEQ ID NO: 698206 - DNA, 25 bp, Rattus norvegicus
ttttgtcattcagttatgtttttgc

SEQ ID NO: 698207 - DNA, 25 bp, Rattus norvegicus
ttttgtccacatcttctctggtcaa

SEQ ID NO: 698208 - DNA, 25 bp, Rattus norvegicus
ttttgtccacatgttctctggtcaa

SEQ ID NO: 698209 - DNA, 25 bp, Rattus norvegicus
ttttgtccacttagttattatttgt

SEQ ID NO: 698210 - DNA, 25 bp, Rattus norvegicus
ttttgtccactttgttattatttgt

SEQ ID NO: 698211 - DNA, 25 bp, Rattus norvegicus
ttttgtcccctacctgaatgtgtgc

SEQ ID NO: 698212 - DNA, 25 bp, Rattus norvegicus
ttttgtcccctagctgaatgtgtgc

SEQ ID NO: 698213 - DNA, 25 bp, Rattus norvegicus
ttttgtcccggtagtatagtaatgt

SEQ ID NO: 698214 - DNA, 25 bp, Rattus norvegicus
ttttgtcccggttgtatagtaatgt

SEQ ID NO: 698215 - DNA, 25 bp, Rattus norvegicus
ttttgtcctctgctttggtggctga

SEQ ID NO: 698216 - DNA, 25 bp, Rattus norvegicus
ttttgtcctctggtttggtggctga

SEQ ID NO: 698217 - DNA, 25 bp, Rattus norvegicus
ttttgtctaaaaagcctccgtgtat

SEQ ID NO: 698218 - DNA, 25 bp, Rattus norvegicus
ttttgtctaaaatgcctccgtgtat

SEQ ID NO: 698219 - DNA, 25 bp, Rattus norvegicus
ttttgtctaggcactccgctgagct

SEQ ID NO: 698220 - DNA, 25 bp, Rattus norvegicus
ttttgtctaggctctccgctgagct

SEQ ID NO: 698221 - DNA, 25 bp, Rattus norvegicus
ttttgtctcatacacacatccgtag

SEQ ID NO: 698222 - DNA, 25 bp, Rattus norvegicus
ttttgtctcatagacacatccgtag

SEQ ID NO: 698223 - DNA, 25 bp, Rattus norvegicus
ttttgtctcccacggtgtgatcaca

SEQ ID NO: 698224 - DNA, 25 bp, Rattus norvegicus
ttttgtctcccagggtgtgatcaca

SEQ ID NO: 698225 - DNA, 25 bp, Rattus norvegicus
ttttgtctccctcttggcttctcag

SEQ ID NO: 698226 - DNA, 25 bp, Rattus norvegicus
ttttgtctccctgttggcttctcag

SEQ ID NO: 698227 - DNA, 25 bp, Rattus norvegicus
ttttgtctctatccttttgttacct

SEQ ID NO: 698228 - DNA, 25 bp, Rattus norvegicus
ttttgtctctatgcttttgttacct

SEQ ID NO: 698229 - DNA, 25 bp, Rattus norvegicus
ttttgtctcttgattttgccctaag

SEQ ID NO: 698230 - DNA, 25 bp, Rattus norvegicus
ttttgtctcttgtttttgccctaag

SEQ ID NO: 698231 - DNA, 25 bp, Rattus norvegicus
ttttgtctgactagattcctatcca

SEQ ID NO: 698232 - DNA, 25 bp, Rattus norvegicus
ttttgtctgacttgattcctatcca

SEQ ID NO: 698233 - DNA, 25 bp, Rattus norvegicus
ttttgtctgcatctggtgtgaccaa

SEQ ID NO: 698234 - DNA, 25 bp, Rattus norvegicus
ttttgtctgcatgtggtgtgaccaa

SEQ ID NO: 698235 - DNA, 25 bp, Rattus norvegicus
ttttgtctgctgactgtctcctgag

SEQ ID NO: 698236 - DNA, 25 bp, Rattus norvegicus
ttttgtctgctgtctgtctcctgag

SEQ ID NO: 698237 - DNA, 25 bp, Rattus norvegicus
ttttgtctgtggaagtatcgcttta

SEQ ID NO: 698238 - DNA, 25 bp, Rattus norvegicus
ttttgtctgtggtagtatcgcttta

SEQ ID NO: 698239 - DNA, 25 bp, Rattus norvegicus
ttttgtctgtgtaattttccccact

SEQ ID NO: 698240 - DNA, 25 bp, Rattus norvegicus
ttttgtctgtgttattttccccact

SEQ ID NO: 698241 - DNA, 25 bp, Rattus norvegicus
ttttgtcttacacgccaggcatgga

SEQ ID NO: 698242 - DNA, 25 bp, Rattus norvegicus
ttttgtcttacaggccaggcatgga

SEQ ID NO: 698243 - DNA, 25 bp, Rattus norvegicus
ttttgtcttcaaatgtccctgtgtt

SEQ ID NO: 698244 - DNA, 25 bp, Rattus norvegicus
ttttgtcttcaattgtccctgtgtt

SEQ ID NO: 698245 - DNA, 25 bp, Rattus norvegicus
ttttgtcttccgcaaacaggccctg

SEQ ID NO: 698246 - DNA, 25 bp, Rattus norvegicus
ttttgtcttccggaaacaggccctg

SEQ ID NO: 698247 - DNA, 25 bp, Rattus norvegicus
ttttgtcttctgagaggtagcttca

SEQ ID NO: 698248 - DNA, 25 bp, Rattus norvegicus
ttttgtcttctgtgaggtagcttca

SEQ ID NO: 698249 - DNA, 25 bp, Rattus norvegicus
ttttgtcttgtcaatcatccttgta

SEQ ID NO: 698250 - DNA, 25 bp, Rattus norvegicus
ttttgtcttgtctatcatccttgta

SEQ ID NO: 698251 - DNA, 25 bp, Rattus norvegicus
ttttgtctttagcatccacactggg

SEQ ID NO: 698252 - DNA, 25 bp, Rattus norvegicus
ttttgtctttaggatccacactggg

SEQ ID NO: 698253 - DNA, 25 bp, Rattus norvegicus
ttttgtctttatctcacctgttggc

SEQ ID NO: 698254 - DNA, 25 bp, Rattus norvegicus
ttttgtctttatgtcacctgttggc

SEQ ID NO: 698255 - DNA, 25 bp, Rattus norvegicus
ttttgtgaagatctccatccaggac

SEQ ID NO: 698256 - DNA, 25 bp, Rattus norvegicus
ttttgtgaagatgtccatccaggac

SEQ ID NO: 698257 - DNA, 25 bp, Rattus norvegicus
ttttgtgacacacggaacatctcaa

SEQ ID NO: 698258 - DNA, 25 bp, Rattus norvegicus
ttttgtgacacagggaacatctcaa

SEQ ID NO: 698259 - DNA, 25 bp, Rattus norvegicus
ttttgtgacccactcttactcatgg

SEQ ID NO: 698260 - DNA, 25 bp, Rattus norvegicus
ttttgtgacccagtcttactcatgg

SEQ ID NO: 698261 - DNA, 25 bp, Rattus norvegicus
ttttgtgactctaacgacacgcgaa

SEQ ID NO: 698262 - DNA, 25 bp, Rattus norvegicus
ttttgtgactcttacgacacgcgaa

SEQ ID NO: 698263 - DNA, 25 bp, Rattus norvegicus
ttttgtgactgcctgctaaaggcca

SEQ ID NO: 698264 - DNA, 25 bp, Rattus norvegicus
ttttgtgactgcgtgctaaaggcca

SEQ ID NO: 698265 - DNA, 25 bp, Rattus norvegicus
ttttgtgagaagatcagcctcctgc

SEQ ID NO: 698266 - DNA, 25 bp, Rattus norvegicus
ttttgtgagaagttcagcctcctgc

SEQ ID NO: 698267 - DNA, 25 bp, Rattus norvegicus
ttttgtgagtgcacgcaggcttgat

SEQ ID NO: 698268 - DNA, 25 bp, Rattus norvegicus
ttttgtgagtgctcgcaggcttgat

SEQ ID NO: 698269 - DNA, 25 bp, Rattus norvegicus
ttttgtgatctaactggaccgctgt

SEQ ID NO: 698270 - DNA, 25 bp, Rattus norvegicus
ttttgtgatctatctggaccgctgt

SEQ ID NO: 698271 - DNA, 25 bp, Rattus norvegicus
ttttgtgatgttctgagctctcctg

SEQ ID NO: 698272 - DNA, 25 bp, Rattus norvegicus
ttttgtgatgttgtgagctctcctg

SEQ ID NO: 698273 - DNA, 25 bp, Rattus norvegicus
ttttgtgcaccaagggagctctgtt

SEQ ID NO: 698274 - DNA, 25 bp, Rattus norvegicus
ttttgtgcaccatgggagctctgtt

SEQ ID NO: 698275 - DNA, 25 bp, Rattus norvegicus
ttttgtgcagcaactaccggtttga

SEQ ID NO: 698276 - DNA, 25 bp, Rattus norvegicus
ttttgtgcagcactttacccagttg

SEQ ID NO: 698277 - DNA, 25 bp, Rattus norvegicus
ttttgtgcagcagtttacccagttg

SEQ ID NO: 698278 - DNA, 25 bp, Rattus norvegicus
ttttgtgcagcatctaccggtttga

SEQ ID NO: 698279 - DNA, 25 bp, Rattus norvegicus
ttttgtgcagttagactcttctcca

SEQ ID NO: 698280 - DNA, 25 bp, Rattus norvegicus
ttttgtgcagtttgactcttctcca

SEQ ID NO: 698281 - DNA, 25 bp, Rattus norvegicus
ttttgtgccagaaacattccgcctt

SEQ ID NO: 698282 - DNA, 25 bp, Rattus norvegicus
ttttgtgccagatacattccgcctt

SEQ ID NO: 698283 - DNA, 25 bp, Rattus norvegicus
ttttgtgccggtatgtgcgtgtgcc

SEQ ID NO: 698284 - DNA, 25 bp, Rattus norvegicus
ttttgtgccggtttgtgcgtgtgcc

SEQ ID NO: 698285 - DNA, 25 bp, Rattus norvegicus
ttttgtgcctgtccagattgcaata

SEQ ID NO: 698286 - DNA, 25 bp, Rattus norvegicus
ttttgtgcctgtgcagattgcaata

SEQ ID NO: 698287 - DNA, 25 bp, Rattus norvegicus
ttttgtgccttgctggctatatccc

SEQ ID NO: 698288 - DNA, 25 bp, Rattus norvegicus
ttttgtgccttggtggctatatccc

SEQ ID NO: 698289 - DNA, 25 bp, Rattus norvegicus
ttttgtgcgggtcagagcatcttct

SEQ ID NO: 698290 - DNA, 25 bp, Rattus norvegicus
ttttgtgcgggtgagagcatcttct

SEQ ID NO: 698291 - DNA, 25 bp, Rattus norvegicus
ttttgtgcgtctcctttgtccattt

SEQ ID NO: 698292 - DNA, 25 bp, Rattus norvegicus
ttttgtgcgtctgctttgtccattt

SEQ ID NO: 698293 - DNA, 25 bp, Rattus norvegicus
ttttgtgcgtgcaaggctcctcagc

SEQ ID NO: 698294 - DNA, 25 bp, Rattus norvegicus
ttttgtgcgtgctaggctcctcagc

SEQ ID NO: 698295 - DNA, 25 bp, Rattus norvegicus
ttttgtgctatcaacaatcccaggc

SEQ ID NO: 698296 - DNA, 25 bp, Rattus norvegicus
ttttgtgctatctacaatcccaggc

SEQ ID NO: 698297 - DNA, 25 bp, Rattus norvegicus
ttttgtgctcataacagaagtggga

SEQ ID NO: 698298 - DNA, 25 bp, Rattus norvegicus
ttttgtgctcattacagaagtggga

SEQ ID NO: 698299 - DNA, 25 bp, Rattus norvegicus
ttttgtgcttctaagtggctttgcc

SEQ ID NO: 698300 - DNA, 25 bp, Rattus norvegicus
ttttgtgcttcttagtggctttgcc

SEQ ID NO: 698301 - DNA, 25 bp, Rattus norvegicus
ttttgtgctttacagggttctcctc

SEQ ID NO: 698302 - DNA, 25 bp, Rattus norvegicus
ttttgtgctttagagggttctcctc

SEQ ID NO: 698303 - DNA, 25 bp, Rattus norvegicus
ttttgtgctttcatgaatgctttgt

SEQ ID NO: 698304 - DNA, 25 bp, Rattus norvegicus
ttttgtgctttcttgaatgctttgt

SEQ ID NO: 698305 - DNA, 25 bp, Rattus norvegicus
ttttgtggagctcctaggacgatct

SEQ ID NO: 698306 - DNA, 25 bp, Rattus norvegicus
ttttgtggagctgctaggacgatct

SEQ ID NO: 698307 - DNA, 25 bp, Rattus norvegicus
ttttgtggcttacccggcctgggct

SEQ ID NO: 698308 - DNA, 25 bp, Rattus norvegicus
ttttgtggcttagccggcctgggct

SEQ ID NO: 698309 - DNA, 25 bp, Rattus norvegicus
ttttgtggtgtcagctcgcaatgcc

SEQ ID NO: 698310 - DNA, 25 bp, Rattus norvegicus
ttttgtggtgtctgctcgcaatgcc

SEQ ID NO: 698311 - DNA, 25 bp, Rattus norvegicus
ttttgtggttacactacgacccatc

SEQ ID NO: 698312 - DNA, 25 bp, Rattus norvegicus
ttttgtggttactctacgacccatc

SEQ ID NO: 698313 - DNA, 25 bp, Rattus norvegicus
ttttgtgtccttctagcaacaataa

SEQ ID NO: 698314 - DNA, 25 bp, Rattus norvegicus
ttttgtgtccttgtagcaacaataa

SEQ ID NO: 698315 - DNA, 25 bp, Rattus norvegicus
ttttgtgtctgaaactggctttgag

SEQ ID NO: 698316 - DNA, 25 bp, Rattus norvegicus
ttttgtgtctgatactggctttgag

SEQ ID NO: 698317 - DNA, 25 bp, Rattus norvegicus
ttttgtgtctggaagttaaactgaa

SEQ ID NO: 698318 - DNA, 25 bp, Rattus norvegicus
ttttgtgtctggtagttaaactgaa

SEQ ID NO: 698319 - DNA, 25 bp, Rattus norvegicus
ttttgtgtcttgatactagccgtca

SEQ ID NO: 698320 - DNA, 25 bp, Rattus norvegicus
ttttgtgtcttgttactagccgtca

SEQ ID NO: 698321 - DNA, 25 bp, Rattus norvegicus
ttttgtgtgctacctctgatgggat

SEQ ID NO: 698322 - DNA, 25 bp, Rattus norvegicus
ttttgtgtgctagctctgatgggat

SEQ ID NO: 698323 - DNA, 25 bp, Rattus norvegicus
ttttgtgtggaaatagctcctcccc

SEQ ID NO: 698324 - DNA, 25 bp, Rattus norvegicus
ttttgtgtggaattagctcctcccc

SEQ ID NO: 698325 - DNA, 25 bp, Rattus norvegicus
ttttgtgtggacagtgaaacttacc

SEQ ID NO: 698326 - DNA, 25 bp, Rattus norvegicus
ttttgtgtggactgtgaaacttacc

SEQ ID NO: 698327 - DNA, 25 bp, Rattus norvegicus
ttttgtgtggtcagaggtatccctc

SEQ ID NO: 698328 - DNA, 25 bp, Rattus norvegicus
ttttgtgtggtctgaggtatccctc

SEQ ID NO: 698329 - DNA, 25 bp, Rattus norvegicus
ttttgtgtgtacagtccttttgaac

SEQ ID NO: 698330 - DNA, 25 bp, Rattus norvegicus
ttttgtgtgtactgtccttttgaac

SEQ ID NO: 698331 - DNA, 25 bp, Rattus norvegicus
ttttgtgttgctcgtctcaggaaag

SEQ ID NO: 698332 - DNA, 25 bp, Rattus norvegicus
ttttgtgttgctggtctcaggaaag

SEQ ID NO: 698333 - DNA, 25 bp, Rattus norvegicus
ttttgtgttggcaggagctggagta

SEQ ID NO: 698334 - DNA, 25 bp, Rattus norvegicus
ttttgtgttggctggagctggagta

SEQ ID NO: 698335 - DNA, 25 bp, Rattus norvegicus
ttttgtgtttttactgtctgatgta

SEQ ID NO: 698336 - DNA, 25 bp, Rattus norvegicus
ttttgtgttttttctgtctgatgta

SEQ ID NO: 698337 - DNA, 25 bp, Rattus norvegicus
ttttgttaatgccttcctcaggtct

SEQ ID NO: 698338 - DNA, 25 bp, Rattus norvegicus
ttttgttaatgcgttcctcaggtct

SEQ ID NO: 698339 - DNA, 25 bp, Rattus norvegicus
ttttgttaccaacatgcggtggcct

SEQ ID NO: 698340 - DNA, 25 bp, Rattus norvegicus
ttttgttaccaagatgcggtggcct

SEQ ID NO: 698341 - DNA, 25 bp, Rattus norvegicus
ttttgttacgccatcgtccaggtct

SEQ ID NO: 698342 - DNA, 25 bp, Rattus norvegicus
ttttgttacgccttcgtccaggtct

SEQ ID NO: 698343 - DNA, 25 bp, Rattus norvegicus
ttttgttactgtcccagaactccag

SEQ ID NO: 698344 - DNA, 25 bp, Rattus norvegicus
ttttgttactgtgccagaactccag

SEQ ID NO: 698345 - DNA, 25 bp, Rattus norvegicus
ttttgttagtgtcaggctcacctgg

SEQ ID NO: 698346 - DNA, 25 bp, Rattus norvegicus
ttttgttagtgtgaggctcacctgg

SEQ ID NO: 698347 - DNA, 25 bp, Rattus norvegicus
ttttgttatgatctctggcttcgct

SEQ ID NO: 698348 - DNA, 25 bp, Rattus norvegicus
ttttgttatgatgtctggcttcgct

SEQ ID NO: 698349 - DNA, 25 bp, Rattus norvegicus
ttttgttatggcatcctgagccgag

SEQ ID NO: 698350 - DNA, 25 bp, Rattus norvegicus
ttttgttatggcttcctgagccgag

SEQ ID NO: 698351 - DNA, 25 bp, Rattus norvegicus
ttttgttattgaaatctcggataca

SEQ ID NO: 698352 - DNA, 25 bp, Rattus norvegicus
ttttgttattgatatctcggataca

SEQ ID NO: 698353 - DNA, 25 bp, Rattus norvegicus
ttttgttcaagtatcctggcatggg

SEQ ID NO: 698354 - DNA, 25 bp, Rattus norvegicus
ttttgttcaagtttcctggcatggg

SEQ ID NO: 698355 - DNA, 25 bp, Rattus norvegicus
ttttgttcagccatctgtcttttta

SEQ ID NO: 698356 - DNA, 25 bp, Rattus norvegicus
ttttgttcagccttctgtcttttta

SEQ ID NO: 698357 - DNA, 25 bp, Rattus norvegicus
ttttgttcccacacatcaagcagca

SEQ ID NO: 698358 - DNA, 25 bp, Rattus norvegicus
ttttgttcccactcatcaagcagca

SEQ ID NO: 698359 - DNA, 25 bp, Rattus norvegicus
ttttgttcctgtcccattagatgct

SEQ ID NO: 698360 - DNA, 25 bp, Rattus norvegicus
ttttgttcctgtgccattagatgct

SEQ ID NO: 698361 - DNA, 25 bp, Rattus norvegicus
ttttgttctgtaatgcatctcccat

SEQ ID NO: 698362 - DNA, 25 bp, Rattus norvegicus
ttttgttctgtattgcatctcccat

SEQ ID NO: 698363 - DNA, 25 bp, Rattus norvegicus
ttttgttctgtcacgggaaactgca

SEQ ID NO: 698364 - DNA, 25 bp, Rattus norvegicus
ttttgttctgtctcgggaaactgca

SEQ ID NO: 698365 - DNA, 25 bp, Rattus norvegicus
ttttgttctgtgagtccattggatt

SEQ ID NO: 698366 - DNA, 25 bp, Rattus norvegicus
ttttgttctgtgtgtccattggatt

SEQ ID NO: 698367 - DNA, 25 bp, Rattus norvegicus
ttttgttcttcaactccattttcag

SEQ ID NO: 698368 - DNA, 25 bp, Rattus norvegicus
ttttgttcttcatctccattttcag

SEQ ID NO: 698369 - DNA, 25 bp, Rattus norvegicus
ttttgttctttcagactgctttgta

SEQ ID NO: 698370 - DNA, 25 bp, Rattus norvegicus
ttttgttctttctgactgctttgta

SEQ ID NO: 698371 - DNA, 25 bp, Rattus norvegicus
ttttgttgaatcattattggtgcta

SEQ ID NO: 698372 - DNA, 25 bp, Rattus norvegicus
ttttgttgaatctttattggtgcta

SEQ ID NO: 698373 - DNA, 25 bp, Rattus norvegicus
ttttgttgatgtctgccttgatgtc

SEQ ID NO: 698374 - DNA, 25 bp, Rattus norvegicus
ttttgttgatgtgtgccttgatgtc

SEQ ID NO: 698375 - DNA, 25 bp, Rattus norvegicus
ttttgttgcaaaccctctctctaga

SEQ ID NO: 698376 - DNA, 25 bp, Rattus norvegicus
ttttgttgcaaagcctctctctaga

SEQ ID NO: 698377 - DNA, 25 bp, Rattus norvegicus
ttttgttgcagtaggcacacagtgc

SEQ ID NO: 698378 - DNA, 25 bp, Rattus norvegicus
ttttgttgcagttggcacacagtgc

SEQ ID NO: 698379 - DNA, 25 bp, Rattus norvegicus
ttttgttgccctataaatgagttag

SEQ ID NO: 698380 - DNA, 25 bp, Rattus norvegicus
ttttgttgccctttaaatgagttag

SEQ ID NO: 698381 - DNA, 25 bp, Rattus norvegicus
ttttgttgggagagatgcctttgaa

SEQ ID NO: 698382 - DNA, 25 bp, Rattus norvegicus
ttttgttgggagtgatgcctttgaa

SEQ ID NO: 698383 - DNA, 25 bp, Rattus norvegicus
ttttgttggttcaaattctgggctc

SEQ ID NO: 698384 - DNA, 25 bp, Rattus norvegicus
ttttgttggttctaattctgggctc

SEQ ID NO: 698385 - DNA, 25 bp, Rattus norvegicus
ttttgttgtactataccggttggca

SEQ ID NO: 698386 - DNA, 25 bp, Rattus norvegicus
ttttgttgtactttaccggttggca

SEQ ID NO: 698387 - DNA, 25 bp, Rattus norvegicus
ttttgttgttgcacttcacagttga

SEQ ID NO: 698388 - DNA, 25 bp, Rattus norvegicus
ttttgttgttgcatcctgactttac

SEQ ID NO: 698389 - DNA, 25 bp, Rattus norvegicus
ttttgttgttgccattcttaggaat

SEQ ID NO: 698390 - DNA, 25 bp, Rattus norvegicus
ttttgttgttgcgattcttaggaat

SEQ ID NO: 698391 - DNA, 25 bp, Rattus norvegicus
ttttgttgttgctcttcacagttga

SEQ ID NO: 698392 - DNA, 25 bp, Rattus norvegicus
ttttgttgttgcttcctgactttac

SEQ ID NO: 698393 - DNA, 25 bp, Rattus norvegicus
ttttgtttcagtactttcccagcct

SEQ ID NO: 698394 - DNA, 25 bp, Rattus norvegicus
ttttgtttcagttctttcccagcct

SEQ ID NO: 698395 - DNA, 25 bp, Rattus norvegicus
ttttgtttcgcgaagttgggccagt

SEQ ID NO: 698396 - DNA, 25 bp, Rattus norvegicus
ttttgtttcgcgtagttgggccagt

SEQ ID NO: 698397 - DNA, 25 bp, Rattus norvegicus
ttttgtttctgtacaactggtgcat

SEQ ID NO: 698398 - DNA, 25 bp, Rattus norvegicus
ttttgtttctgtcctaggactcgcc

SEQ ID NO: 698399 - DNA, 25 bp, Rattus norvegicus
ttttgtttctgtgctaggactcgcc

SEQ ID NO: 698400 - DNA, 25 bp, Rattus norvegicus
ttttgtttctgttcaactggtgcat

SEQ ID NO: 698401 - DNA, 25 bp, Rattus norvegicus
ttttgtttgattctggttcttttgt

SEQ ID NO: 698402 - DNA, 25 bp, Rattus norvegicus
ttttgtttgattgtggttcttttgt

SEQ ID NO: 698403 - DNA, 25 bp, Rattus norvegicus
ttttgtttgtgtatccaaggcctga

SEQ ID NO: 698404 - DNA, 25 bp, Rattus norvegicus
ttttgtttgtgtttccaaggcctga

SEQ ID NO: 698405 - DNA, 25 bp, Rattus norvegicus
ttttgtttgttactgactccccaca

SEQ ID NO: 698406 - DNA, 25 bp, Rattus norvegicus
ttttgtttgttagtgactccccaca

SEQ ID NO: 698407 - DNA, 25 bp, Rattus norvegicus
ttttgtttgttgaaatgtctaattc

SEQ ID NO: 698408 - DNA, 25 bp, Rattus norvegicus
ttttgtttgttgtaatgtctaattc

SEQ ID NO: 698409 - DNA, 25 bp, Rattus norvegicus
ttttgttttacacactctcccaact

SEQ ID NO: 698410 - DNA, 25 bp, Rattus norvegicus
ttttgttttacagactctcccaact

SEQ ID NO: 698411 - DNA, 25 bp, Rattus norvegicus
ttttgttttcccatgatctaaagag

SEQ ID NO: 698412 - DNA, 25 bp, Rattus norvegicus
ttttgttttcccttgatctaaagag

SEQ ID NO: 698413 - DNA, 25 bp, Rattus norvegicus
ttttgttttctgaaggtacccacag

SEQ ID NO: 698414 - DNA, 25 bp, Rattus norvegicus
ttttgttttctgtaggtacccacag

SEQ ID NO: 698415 - DNA, 25 bp, Rattus norvegicus
ttttgttttcttaggcagggacaga

SEQ ID NO: 698416 - DNA, 25 bp, Rattus norvegicus
ttttgttttctttggcagggacaga

SEQ ID NO: 698417 - DNA, 25 bp, Rattus norvegicus
ttttgttttgagacactgcctcacc

SEQ ID NO: 698418 - DNA, 25 bp, Rattus norvegicus
ttttgttttgagtcactgcctcacc

SEQ ID NO: 698419 - DNA, 25 bp, Rattus norvegicus
ttttgtttttcactccaggttggag

SEQ ID NO: 698420 - DNA, 25 bp, Rattus norvegicus
ttttgtttttcagtccaggttggag

SEQ ID NO: 698421 - DNA, 25 bp, Rattus norvegicus
ttttgtttttccaccgaacgcactg

SEQ ID NO: 698422 - DNA, 25 bp, Rattus norvegicus
ttttgtttttcctccgaacgcactg

SEQ ID NO: 698423 - DNA, 25 bp, Rattus norvegicus
ttttgtttttctacggcttatctgc

SEQ ID NO: 698424 - DNA, 25 bp, Rattus norvegicus
ttttgtttttcttcggcttatctgc

SEQ ID NO: 698425 - DNA, 25 bp, Rattus norvegicus
ttttgtttttgccacaagatcttca

SEQ ID NO: 698426 - DNA, 25 bp, Rattus norvegicus
ttttgtttttgcgacaagatcttca

SEQ ID NO: 698427 - DNA, 25 bp, Rattus norvegicus
ttttgttttttacaccagagcagtg

SEQ ID NO: 698428 - DNA, 25 bp, Rattus norvegicus
ttttgttttttagaccagagcagtg

SEQ ID NO: 698429 - DNA, 25 bp, Rattus norvegicus
tttttaaacgctactgtagtataat

SEQ ID NO: 698430 - DNA, 25 bp, Rattus norvegicus
tttttaaacgcttctgtagtataat

SEQ ID NO: 698431 - DNA, 25 bp, Rattus norvegicus
tttttaaactccacacagactctgc

SEQ ID NO: 698432 - DNA, 25 bp, Rattus norvegicus
tttttaaactcctcacagactctgc

SEQ ID NO: 698433 - DNA, 25 bp, Rattus norvegicus
tttttaaactgtctctagattctgg

SEQ ID NO: 698434 - DNA, 25 bp, Rattus norvegicus
tttttaaactgtgtctagattctgg

SEQ ID NO: 698435 - DNA, 25 bp, Rattus norvegicus
tttttaaatgcccattcccgcctcg

SEQ ID NO: 698436 - DNA, 25 bp, Rattus norvegicus
tttttaaatgccgattcccgcctcg

SEQ ID NO: 698437 - DNA, 25 bp, Rattus norvegicus
tttttaaatgtccaccttcctctct

SEQ ID NO: 698438 - DNA, 25 bp, Rattus norvegicus
tttttaaatgtcgaccttcctctct

SEQ ID NO: 698439 - DNA, 25 bp, Rattus norvegicus
tttttaacaccactagagacctttg

SEQ ID NO: 698440 - DNA, 25 bp, Rattus norvegicus
tttttaacaccagtagagacctttg

SEQ ID NO: 698441 - DNA, 25 bp, Rattus norvegicus
tttttaacatctcagggccttgggc

SEQ ID NO: 698442 - DNA, 25 bp, Rattus norvegicus
tttttaacatctgagggccttgggc

SEQ ID NO: 698443 - DNA, 25 bp, Rattus norvegicus
tttttaacatttctcactgcctacg

SEQ ID NO: 698444 - DNA, 25 bp, Rattus norvegicus
tttttaacatttgtcactgcctacg

SEQ ID NO: 698445 - DNA, 25 bp, Rattus norvegicus
tttttaaccaaaagaccaggcagca

SEQ ID NO: 698446 - DNA, 25 bp, Rattus norvegicus
tttttaaccaaatgaccaggcagca

SEQ ID NO: 698447 - DNA, 25 bp, Rattus norvegicus
tttttaaccctacccattgatcatt

SEQ ID NO: 698448 - DNA, 25 bp, Rattus norvegicus
tttttaaccctagccattgatcatt

SEQ ID NO: 698449 - DNA, 25 bp, Rattus norvegicus
tttttaaccggcagtccttctcgct

SEQ ID NO: 698450 - DNA, 25 bp, Rattus norvegicus
tttttaaccggctgtccttctcgct

SEQ ID NO: 698451 - DNA, 25 bp, Rattus norvegicus
tttttaaccgtacctacccaatgag

SEQ ID NO: 698452 - DNA, 25 bp, Rattus norvegicus
tttttaaccgtagctacccaatgag

SEQ ID NO: 698453 - DNA, 25 bp, Rattus norvegicus
tttttaacctgtctttctgccttca

SEQ ID NO: 698454 - DNA, 25 bp, Rattus norvegicus
tttttaacctgtgtttctgccttca

SEQ ID NO: 698455 - DNA, 25 bp, Rattus norvegicus
tttttaacgttgaacctctggatat

SEQ ID NO: 698456 - DNA, 25 bp, Rattus norvegicus
tttttaacgttgtacctctggatat

SEQ ID NO: 698457 - DNA, 25 bp, Rattus norvegicus
tttttaagatctccgtccaaagttc

SEQ ID NO: 698458 - DNA, 25 bp, Rattus norvegicus
tttttaagatctgcgtccaaagttc

SEQ ID NO: 698459 - DNA, 25 bp, Rattus norvegicus
tttttaagccaccttgcctcagaaa

SEQ ID NO: 698460 - DNA, 25 bp, Rattus norvegicus
tttttaagccacgttgcctcagaaa

SEQ ID NO: 698461 - DNA, 25 bp, Rattus norvegicus
tttttaagtccacccgctgagaagg

SEQ ID NO: 698462 - DNA, 25 bp, Rattus norvegicus
tttttaagtccagccgctgagaagg

SEQ ID NO: 698463 - DNA, 25 bp, Rattus norvegicus
tttttaagttgcagccgactctcca

SEQ ID NO: 698464 - DNA, 25 bp, Rattus norvegicus
tttttaagttgctgccgactctcca

SEQ ID NO: 698465 - DNA, 25 bp, Rattus norvegicus
tttttaagtttcctcctccgccatg

SEQ ID NO: 698466 - DNA, 25 bp, Rattus norvegicus
tttttaagtttcgtcctccgccatg

SEQ ID NO: 698467 - DNA, 25 bp, Rattus norvegicus
tttttaatctgacctgtgcctgtac

SEQ ID NO: 698468 - DNA, 25 bp, Rattus norvegicus
tttttaatctgagctgtgcctgtac

SEQ ID NO: 698469 - DNA, 25 bp, Rattus norvegicus
tttttaatgcccaagttctttctct

SEQ ID NO: 698470 - DNA, 25 bp, Rattus norvegicus
tttttaatgccctagttctttctct

SEQ ID NO: 698471 - DNA, 25 bp, Rattus norvegicus
tttttaatgcttatggtggccctct

SEQ ID NO: 698472 - DNA, 25 bp, Rattus norvegicus
tttttaatgcttttggtggccctct

SEQ ID NO: 698473 - DNA, 25 bp, Rattus norvegicus
tttttaatgtggctctccctcaggg

SEQ ID NO: 698474 - DNA, 25 bp, Rattus norvegicus
tttttaatgtgggtctccctcaggg

SEQ ID NO: 698475 - DNA, 25 bp, Rattus norvegicus
tttttaattatgcatctcctggatg

SEQ ID NO: 698476 - DNA, 25 bp, Rattus norvegicus
tttttaattatggatctcctggatg

SEQ ID NO: 698477 - DNA, 25 bp, Rattus norvegicus
tttttaatttacagcccaccactag

SEQ ID NO: 698478 - DNA, 25 bp, Rattus norvegicus
tttttaatttactgcccaccactag

SEQ ID NO: 698479 - DNA, 25 bp, Rattus norvegicus
tttttacaacagatggcgcaccaaa

SEQ ID NO: 698480 - DNA, 25 bp, Rattus norvegicus
tttttacaacagttggcgcaccaaa

SEQ ID NO: 698481 - DNA, 25 bp, Rattus norvegicus
tttttacacaggcaggcgatagcta

SEQ ID NO: 698482 - DNA, 25 bp, Rattus norvegicus
tttttacacagggaggcgatagcta

SEQ ID NO: 698483 - DNA, 25 bp, Rattus norvegicus
tttttacacctgcaagtccatctta

SEQ ID NO: 698484 - DNA, 25 bp, Rattus norvegicus
tttttacacctggaagtccatctta

SEQ ID NO: 698485 - DNA, 25 bp, Rattus norvegicus
tttttacactaacaccagagatcct

SEQ ID NO: 698486 - DNA, 25 bp, Rattus norvegicus
tttttacactaagaccagagatcct

SEQ ID NO: 698487 - DNA, 25 bp, Rattus norvegicus
tttttacagctcattgacatccatg

SEQ ID NO: 698488 - DNA, 25 bp, Rattus norvegicus
tttttacagctctttgacatccatg

SEQ ID NO: 698489 - DNA, 25 bp, Rattus norvegicus
tttttacaggtccagcactgcaggg

SEQ ID NO: 698490 - DNA, 25 bp, Rattus norvegicus
tttttacaggtcgagcactgcaggg

SEQ ID NO: 698491 - DNA, 25 bp, Rattus norvegicus
tttttaccattgctacatgtcccac

SEQ ID NO: 698492 - DNA, 25 bp, Rattus norvegicus
tttttaccattggtacatgtcccac

SEQ ID NO: 698493 - DNA, 25 bp, Rattus norvegicus
tttttaccccaaagcctagagccat

SEQ ID NO: 698494 - DNA, 25 bp, Rattus norvegicus
tttttaccccaatgcctagagccat

SEQ ID NO: 698495 - DNA, 25 bp, Rattus norvegicus
tttttaccgcaacgactggaaatcg

SEQ ID NO: 698496 - DNA, 25 bp, Rattus norvegicus
tttttaccgcaaggactggaaatcg

SEQ ID NO: 698497 - DNA, 25 bp, Rattus norvegicus
tttttaccgcatagtggctgctcac

SEQ ID NO: 698498 - DNA, 25 bp, Rattus norvegicus
tttttaccgcattgtggctgctcac

SEQ ID NO: 698499 - DNA, 25 bp, Rattus norvegicus
tttttaccgggaattctctcagcca

SEQ ID NO: 698500 - DNA, 25 bp, Rattus norvegicus
tttttaccgggatttctctcagcca

SEQ ID NO: 698501 - DNA, 25 bp, Rattus norvegicus
tttttacctccaccgcaggcgatta

SEQ ID NO: 698502 - DNA, 25 bp, Rattus norvegicus
tttttacctccagcgcaggcgatta

SEQ ID NO: 698503 - DNA, 25 bp, Rattus norvegicus
tttttacctttgataccaccaacag

SEQ ID NO: 698504 - DNA, 25 bp, Rattus norvegicus
tttttacctttgttaccaccaacag

SEQ ID NO: 698505 - DNA, 25 bp, Rattus norvegicus
tttttacgatttagatgttcctaat

SEQ ID NO: 698506 - DNA, 25 bp, Rattus norvegicus
tttttacgattttgatgttcctaat

SEQ ID NO: 698507 - DNA, 25 bp, Rattus norvegicus
tttttacgtccaccaagattcaccc

SEQ ID NO: 698508 - DNA, 25 bp, Rattus norvegicus
tttttacgtccagcaagattcaccc

SEQ ID NO: 698509 - DNA, 25 bp, Rattus norvegicus
tttttactaccaacttttctactcg

SEQ ID NO: 698510 - DNA, 25 bp, Rattus norvegicus
tttttactaccatcttttctactcg

SEQ ID NO: 698511 - DNA, 25 bp, Rattus norvegicus
tttttactcatgacatctgtccagc

SEQ ID NO: 698512 - DNA, 25 bp, Rattus norvegicus
tttttactcatgtcatctgtccagc

SEQ ID NO: 698513 - DNA, 25 bp, Rattus norvegicus
tttttactgaaactgcatggcctgc

SEQ ID NO: 698514 - DNA, 25 bp, Rattus norvegicus
tttttactgaaagtgcatggcctgc

SEQ ID NO: 698515 - DNA, 25 bp, Rattus norvegicus
tttttactgcacatcctaaggacac

SEQ ID NO: 698516 - DNA, 25 bp, Rattus norvegicus
tttttactgcacttcctaaggacac

SEQ ID NO: 698517 - DNA, 25 bp, Rattus norvegicus
tttttactgccaactcaattgacat

SEQ ID NO: 698518 - DNA, 25 bp, Rattus norvegicus
tttttactgccatctcaattgacat

SEQ ID NO: 698519 - DNA, 25 bp, Rattus norvegicus
tttttactggggattcttgaacttg

SEQ ID NO: 698520 - DNA, 25 bp, Rattus norvegicus
tttttactggggtttcttgaacttg

SEQ ID NO: 698521 - DNA, 25 bp, Rattus norvegicus
tttttactggtgacttctgaactca

SEQ ID NO: 698522 - DNA, 25 bp, Rattus norvegicus
tttttactggtgtcttctgaactca

SEQ ID NO: 698523 - DNA, 25 bp, Rattus norvegicus
tttttactgtggaagctcccatgtt

SEQ ID NO: 698524 - DNA, 25 bp, Rattus norvegicus
tttttactgtggtagctcccatgtt

SEQ ID NO: 698525 - DNA, 25 bp, Rattus norvegicus
tttttacttcatactccctgtgtat

SEQ ID NO: 698526 - DNA, 25 bp, Rattus norvegicus
tttttacttcattctccctgtgtat

SEQ ID NO: 698527 - DNA, 25 bp, Rattus norvegicus
tttttagaacttcacttcccgcact

SEQ ID NO: 698528 - DNA, 25 bp, Rattus norvegicus
tttttagaacttgacttcccgcact

SEQ ID NO: 698529 - DNA, 25 bp, Rattus norvegicus
tttttagacccactgctcctttaat

SEQ ID NO: 698530 - DNA, 25 bp, Rattus norvegicus
tttttagacccagtgctcctttaat

SEQ ID NO: 698531 - DNA, 25 bp, Rattus norvegicus
tttttagcagcgcttccaggatccg

SEQ ID NO: 698532 - DNA, 25 bp, Rattus norvegicus
tttttagcagcggttccaggatccg

SEQ ID NO: 698533 - DNA, 25 bp, Rattus norvegicus
tttttagcccaaacgtttgcagcca

SEQ ID NO: 698534 - DNA, 25 bp, Rattus norvegicus
tttttagcccaatcgtttgcagcca

SEQ ID NO: 698535 - DNA, 25 bp, Rattus norvegicus
tttttagcccagcttggtagcccac

SEQ ID NO: 698536 - DNA, 25 bp, Rattus norvegicus
tttttagcccaggttggtagcccac

SEQ ID NO: 698537 - DNA, 25 bp, Rattus norvegicus
tttttagcctgtcctgttaacagct

SEQ ID NO: 698538 - DNA, 25 bp, Rattus norvegicus
tttttagcctgtgctgttaacagct

SEQ ID NO: 698539 - DNA, 25 bp, Rattus norvegicus
tttttagctaagaccctgcaggacg

SEQ ID NO: 698540 - DNA, 25 bp, Rattus norvegicus
tttttagctaagtccctgcaggacg

SEQ ID NO: 698541 - DNA, 25 bp, Rattus norvegicus
tttttagctaataatctccggagaa

SEQ ID NO: 698542 - DNA, 25 bp, Rattus norvegicus
tttttagctaattatctccggagaa

SEQ ID NO: 698543 - DNA, 25 bp, Rattus norvegicus
tttttagctcctcagtctaacgtgg

SEQ ID NO: 698544 - DNA, 25 bp, Rattus norvegicus
tttttagctcctgagtctaacgtgg

SEQ ID NO: 698545 - DNA, 25 bp, Rattus norvegicus
tttttagctcttcaaacccatcgtc

SEQ ID NO: 698546 - DNA, 25 bp, Rattus norvegicus
tttttagctcttgaaacccatcgtc

SEQ ID NO: 698547 - DNA, 25 bp, Rattus norvegicus
tttttaggccccacagacagtggtg

SEQ ID NO: 698548 - DNA, 25 bp, Rattus norvegicus
tttttaggcccctcagacagtggtg

SEQ ID NO: 698549 - DNA, 25 bp, Rattus norvegicus
tttttagtaatcagcgtctccttgg

SEQ ID NO: 698550 - DNA, 25 bp, Rattus norvegicus
tttttagtaatctgcgtctccttgg

SEQ ID NO: 698551 - DNA, 25 bp, Rattus norvegicus
tttttagttgctcgccacttagctc

SEQ ID NO: 698552 - DNA, 25 bp, Rattus norvegicus
tttttagttgctggccacttagctc

SEQ ID NO: 698553 - DNA, 25 bp, Rattus norvegicus
tttttatacccaacaccactcttgg

SEQ ID NO: 698554 - DNA, 25 bp, Rattus norvegicus
tttttatacccatcaccactcttgg

SEQ ID NO: 698555 - DNA, 25 bp, Rattus norvegicus
tttttataccctcattcgctgcctg

SEQ ID NO: 698556 - DNA, 25 bp, Rattus norvegicus
tttttataccctgattcgctgcctg

SEQ ID NO: 698557 - DNA, 25 bp, Rattus norvegicus
tttttatactcaatccttctgggca

SEQ ID NO: 698558 - DNA, 25 bp, Rattus norvegicus
tttttatactcattccttctgggca

SEQ ID NO: 698559 - DNA, 25 bp, Rattus norvegicus
tttttatatagcacaggctgtcctg

SEQ ID NO: 698560 - DNA, 25 bp, Rattus norvegicus
tttttatatagctcaggctgtcctg

SEQ ID NO: 698561 - DNA, 25 bp, Rattus norvegicus
tttttatatcttacaacattcgcgg

SEQ ID NO: 698562 - DNA, 25 bp, Rattus norvegicus
tttttatatctttcaacattcgcgg

SEQ ID NO: 698563 - DNA, 25 bp, Rattus norvegicus
tttttatcaaccaaccccgatctat

SEQ ID NO: 698564 - DNA, 25 bp, Rattus norvegicus
tttttatcaacctaccccgatctat

SEQ ID NO: 698565 - DNA, 25 bp, Rattus norvegicus
tttttatccttgactcaaactgtgg

SEQ ID NO: 698566 - DNA, 25 bp, Rattus norvegicus
tttttatccttgtctcaaactgtgg

SEQ ID NO: 698567 - DNA, 25 bp, Rattus norvegicus
tttttatctcccacagcctattaag

SEQ ID NO: 698568 - DNA, 25 bp, Rattus norvegicus
tttttatctccctcagcctattaag

SEQ ID NO: 698569 - DNA, 25 bp, Rattus norvegicus
tttttatgaagcatcaccagtctca

SEQ ID NO: 698570 - DNA, 25 bp, Rattus norvegicus
tttttatgaagcttcaccagtctca

SEQ ID NO: 698571 - DNA, 25 bp, Rattus norvegicus
tttttatgtatccaaatgctagcac

SEQ ID NO: 698572 - DNA, 25 bp, Rattus norvegicus
tttttatgtatcgaaatgctagcac

SEQ ID NO: 698573 - DNA, 25 bp, Rattus norvegicus
tttttatgtggcattcaggtccctt

SEQ ID NO: 698574 - DNA, 25 bp, Rattus norvegicus
tttttatgtggctttcaggtccctt

SEQ ID NO: 698575 - DNA, 25 bp, Rattus norvegicus
tttttattcgtaagcttcctctcag

SEQ ID NO: 698576 - DNA, 25 bp, Rattus norvegicus
tttttattcgtatgcttcctctcag

SEQ ID NO: 698577 - DNA, 25 bp, Rattus norvegicus
tttttattctgcactgcacaccaag

SEQ ID NO: 698578 - DNA, 25 bp, Rattus norvegicus
tttttattctgctctgcacaccaag

SEQ ID NO: 698579 - DNA, 25 bp, Rattus norvegicus
tttttattctttcacctgcagacag

SEQ ID NO: 698580 - DNA, 25 bp, Rattus norvegicus
tttttattctttgacctgcagacag

SEQ ID NO: 698581 - DNA, 25 bp, Rattus norvegicus
tttttattgttcatacttagtatga

SEQ ID NO: 698582 - DNA, 25 bp, Rattus norvegicus
tttttattgttcttacttagtatga

SEQ ID NO: 698583 - DNA, 25 bp, Rattus norvegicus
tttttatttactcaccatcctgtct

SEQ ID NO: 698584 - DNA, 25 bp, Rattus norvegicus
tttttatttactgaccatcctgtct

SEQ ID NO: 698585 - DNA, 25 bp, Rattus norvegicus
tttttatttatcctaactctccctg

SEQ ID NO: 698586 - DNA, 25 bp, Rattus norvegicus
tttttatttatcgtaactctccctg

SEQ ID NO: 698587 - DNA, 25 bp, Rattus norvegicus
tttttatttattctcacggtgcaga

SEQ ID NO: 698588 - DNA, 25 bp, Rattus norvegicus
tttttatttattgtcacggtgcaga

SEQ ID NO: 698589 - DNA, 25 bp, Rattus norvegicus
tttttattttcaagcctccctctag

SEQ ID NO: 698590 - DNA, 25 bp, Rattus norvegicus
tttttattttcatgcctccctctag

SEQ ID NO: 698591 - DNA, 25 bp, Rattus norvegicus
tttttcaaaccacggctagactctt

SEQ ID NO: 698592 - DNA, 25 bp, Rattus norvegicus
tttttcaaaccagggctagactctt

SEQ ID NO: 698593 - DNA, 25 bp, Rattus norvegicus
tttttcaaacttccctccatgagaa

SEQ ID NO: 698594 - DNA, 25 bp, Rattus norvegicus
tttttcaaacttgcctccatgagaa

SEQ ID NO: 698595 - DNA, 25 bp, Rattus norvegicus
tttttcaacagaacacaaggactag

SEQ ID NO: 698596 - DNA, 25 bp, Rattus norvegicus
tttttcaacagatcacaaggactag

SEQ ID NO: 698597 - DNA, 25 bp, Rattus norvegicus
tttttcaacattaccagcaaactgg

SEQ ID NO: 698598 - DNA, 25 bp, Rattus norvegicus
tttttcaacatttccagcaaactgg

SEQ ID NO: 698599 - DNA, 25 bp, Rattus norvegicus
tttttcaagaccaaactgcagccgc

SEQ ID NO: 698600 - DNA, 25 bp, Rattus norvegicus
tttttcaagacctaactgcagccgc

SEQ ID NO: 698601 - DNA, 25 bp, Rattus norvegicus
tttttcaagaggctgtggcggactt

SEQ ID NO: 698602 - DNA, 25 bp, Rattus norvegicus
tttttcaagagggtgtggcggactt

SEQ ID NO: 698603 - DNA, 25 bp, Rattus norvegicus
tttttcaagttccatccacagtcta

SEQ ID NO: 698604 - DNA, 25 bp, Rattus norvegicus
tttttcaagttcgatccacagtcta

SEQ ID NO: 698605 - DNA, 25 bp, Rattus norvegicus
tttttcaattacctgtccgacacca

SEQ ID NO: 698606 - DNA, 25 bp, Rattus norvegicus
tttttcaattacgtgtccgacacca

SEQ ID NO: 698607 - DNA, 25 bp, Rattus norvegicus
tttttcacagtcctcgagctttaac

SEQ ID NO: 698608 - DNA, 25 bp, Rattus norvegicus
tttttcacagtcgtcgagctttaac

SEQ ID NO: 698609 - DNA, 25 bp, Rattus norvegicus
tttttcaccataatacaagccacat

SEQ ID NO: 698610 - DNA, 25 bp, Rattus norvegicus
tttttcaccatattacaagccacat

SEQ ID NO: 698611 - DNA, 25 bp, Rattus norvegicus
tttttcactgacagtgttttgttaa

SEQ ID NO: 698612 - DNA, 25 bp, Rattus norvegicus
tttttcactgactgtgttttgttaa

SEQ ID NO: 698613 - DNA, 25 bp, Rattus norvegicus
tttttcactgttccagtcgctgtaa

SEQ ID NO: 698614 - DNA, 25 bp, Rattus norvegicus
tttttcactgttgcagtcgctgtaa

SEQ ID NO: 698615 - DNA, 25 bp, Rattus norvegicus
tttttcacttaaaagctgcgctggt

SEQ ID NO: 698616 - DNA, 25 bp, Rattus norvegicus
tttttcacttaatagctgcgctggt

SEQ ID NO: 698617 - DNA, 25 bp, Rattus norvegicus
tttttcactttgatgagcctttcag

SEQ ID NO: 698618 - DNA, 25 bp, Rattus norvegicus
tttttcactttgttgagcctttcag

SEQ ID NO: 698619 - DNA, 25 bp, Rattus norvegicus
tttttcagatgtcctgccagcagca

SEQ ID NO: 698620 - DNA, 25 bp, Rattus norvegicus
tttttcagatgtgctgccagcagca

SEQ ID NO: 698621 - DNA, 25 bp, Rattus norvegicus
tttttcagccgcatcagtacccgaa

SEQ ID NO: 698622 - DNA, 25 bp, Rattus norvegicus
tttttcagccgcttcagtacccgaa

SEQ ID NO: 698623 - DNA, 25 bp, Rattus norvegicus
tttttcagggctcttcaactacagg

SEQ ID NO: 698624 - DNA, 25 bp, Rattus norvegicus
tttttcagggctgttcaactacagg

SEQ ID NO: 698625 - DNA, 25 bp, Rattus norvegicus
tttttcaggtgtcgctgatccccac

SEQ ID NO: 698626 - DNA, 25 bp, Rattus norvegicus
tttttcaggtgtggctgatccccac

SEQ ID NO: 698627 - DNA, 25 bp, Rattus norvegicus
tttttcagtgatatttccaaagcag

SEQ ID NO: 698628 - DNA, 25 bp, Rattus norvegicus
tttttcagtgatttttccaaagcag

SEQ ID NO: 698629 - DNA, 25 bp, Rattus norvegicus
tttttcatagagacacttccctccc

SEQ ID NO: 698630 - DNA, 25 bp, Rattus norvegicus
tttttcatagagtcacttccctccc

SEQ ID NO: 698631 - DNA, 25 bp, Rattus norvegicus
tttttcatagctaaggtcgtcccct

SEQ ID NO: 698632 - DNA, 25 bp, Rattus norvegicus
tttttcatagcttaggtcgtcccct

SEQ ID NO: 698633 - DNA, 25 bp, Rattus norvegicus
tttttcatcaatcttgtgggtgcca

SEQ ID NO: 698634 - DNA, 25 bp, Rattus norvegicus
tttttcatcaatgttgtgggtgcca

SEQ ID NO: 698635 - DNA, 25 bp, Rattus norvegicus
tttttcatcatcattcctacaacct

SEQ ID NO: 698636 - DNA, 25 bp, Rattus norvegicus
tttttcatcatctttcctacaacct

SEQ ID NO: 698637 - DNA, 25 bp, Rattus norvegicus
tttttcatgttaatcacagctgtca

SEQ ID NO: 698638 - DNA, 25 bp, Rattus norvegicus
tttttcatgttattcacagctgtca

SEQ ID NO: 698639 - DNA, 25 bp, Rattus norvegicus
tttttcattattcctttatacctag

SEQ ID NO: 698640 - DNA, 25 bp, Rattus norvegicus
tttttcattattgctttatacctag

SEQ ID NO: 698641 - DNA, 25 bp, Rattus norvegicus
tttttccaacgaaagcacagccgtg

SEQ ID NO: 698642 - DNA, 25 bp, Rattus norvegicus
tttttccaacgatagcacagccgtg

SEQ ID NO: 698643 - DNA, 25 bp, Rattus norvegicus
tttttccacaggagatcgagcttct

SEQ ID NO: 698644 - DNA, 25 bp, Rattus norvegicus
tttttccacaggtgatcgagcttct

SEQ ID NO: 698645 - DNA, 25 bp, Rattus norvegicus
tttttccacggcctagcttgaggtt

SEQ ID NO: 698646 - DNA, 25 bp, Rattus norvegicus
tttttccacggcgtagcttgaggtt

SEQ ID NO: 698647 - DNA, 25 bp, Rattus norvegicus
tttttccagattaacctgccattga

SEQ ID NO: 698648 - DNA, 25 bp, Rattus norvegicus
tttttccagatttacctgccattga

SEQ ID NO: 698649 - DNA, 25 bp, Rattus norvegicus
tttttccagcataatttcatggtag

SEQ ID NO: 698650 - DNA, 25 bp, Rattus norvegicus
tttttccagcattatttcatggtag

SEQ ID NO: 698651 - DNA, 25 bp, Rattus norvegicus
tttttccatatcctaagggcatgcg

SEQ ID NO: 698652 - DNA, 25 bp, Rattus norvegicus
tttttccatatcgtaagggcatgcg

SEQ ID NO: 698653 - DNA, 25 bp, Rattus norvegicus
tttttccatccactaatatctctct

SEQ ID NO: 698654 - DNA, 25 bp, Rattus norvegicus
tttttccatccagtaatatctctct

SEQ ID NO: 698655 - DNA, 25 bp, Rattus norvegicus
tttttccatcccatttcctttgtca

SEQ ID NO: 698656 - DNA, 25 bp, Rattus norvegicus
tttttccatcccttttcctttgtca

SEQ ID NO: 698657 - DNA, 25 bp, Rattus norvegicus
tttttccatcctctgaatttccatg

SEQ ID NO: 698658 - DNA, 25 bp, Rattus norvegicus
tttttccatcctgtgaatttccatg

SEQ ID NO: 698659 - DNA, 25 bp, Rattus norvegicus
tttttccatgaccataaccgagcgc

SEQ ID NO: 698660 - DNA, 25 bp, Rattus norvegicus
tttttccatgacgataaccgagcgc

SEQ ID NO: 698661 - DNA, 25 bp, Rattus norvegicus
tttttccatttgaacctttggccat

SEQ ID NO: 698662 - DNA, 25 bp, Rattus norvegicus
tttttccatttgtacctttggccat

SEQ ID NO: 698663 - DNA, 25 bp, Rattus norvegicus
tttttcccaaaaccgcatttactat

SEQ ID NO: 698664 - DNA, 25 bp, Rattus norvegicus
tttttcccaaaagcgcatttactat

SEQ ID NO: 698665 - DNA, 25 bp, Rattus norvegicus
tttttcccaaacagggtgcagtact

SEQ ID NO: 698666 - DNA, 25 bp, Rattus norvegicus
tttttcccaaactgggtgcagtact

SEQ ID NO: 698667 - DNA, 25 bp, Rattus norvegicus
tttttcccaaggagtaacaggccat

SEQ ID NO: 698668 - DNA, 25 bp, Rattus norvegicus
tttttcccaaggtgtaacaggccat

SEQ ID NO: 698669 - DNA, 25 bp, Rattus norvegicus
tttttcccagagctttcaggtgctg

SEQ ID NO: 698670 - DNA, 25 bp, Rattus norvegicus
tttttcccagaggtttcaggtgctg

SEQ ID NO: 698671 - DNA, 25 bp, Rattus norvegicus
tttttcccagcgcttggcacagaac

SEQ ID NO: 698672 - DNA, 25 bp, Rattus norvegicus
tttttcccagcggttggcacagaac

SEQ ID NO: 698673 - DNA, 25 bp, Rattus norvegicus
tttttcccagtcaagccgagaggct

SEQ ID NO: 698674 - DNA, 25 bp, Rattus norvegicus
tttttcccagtctagccgagaggct

SEQ ID NO: 698675 - DNA, 25 bp, Rattus norvegicus
tttttcccatccactcaaagacaaa

SEQ ID NO: 698676 - DNA, 25 bp, Rattus norvegicus
tttttcccatcctctcaaagacaaa

SEQ ID NO: 698677 - DNA, 25 bp, Rattus norvegicus
tttttccccaataaatttgccatat

SEQ ID NO: 698678 - DNA, 25 bp, Rattus norvegicus
tttttccccaattaatttgccatat

SEQ ID NO: 698679 - DNA, 25 bp, Rattus norvegicus
tttttcccctccactgaagaagtat

SEQ ID NO: 698680 - DNA, 25 bp, Rattus norvegicus
tttttcccctcctctgaagaagtat

SEQ ID NO: 698681 - DNA, 25 bp, Rattus norvegicus
tttttccctagcagcaccagaatta

SEQ ID NO: 698682 - DNA, 25 bp, Rattus norvegicus
tttttccctagctgcaccagaatta

SEQ ID NO: 698683 - DNA, 25 bp, Rattus norvegicus
tttttccctcgaccccagagaacag

SEQ ID NO: 698684 - DNA, 25 bp, Rattus norvegicus
tttttccctcgagcccagagaacag

SEQ ID NO: 698685 - DNA, 25 bp, Rattus norvegicus
tttttccctggtatcaatgacttat

SEQ ID NO: 698686 - DNA, 25 bp, Rattus norvegicus
tttttccctggtttcaatgacttat

SEQ ID NO: 698687 - DNA, 25 bp, Rattus norvegicus
tttttcccttgtatttctctgattg

SEQ ID NO: 698688 - DNA, 25 bp, Rattus norvegicus
tttttcccttgtttttctctgattg

SEQ ID NO: 698689 - DNA, 25 bp, Rattus norvegicus
tttttccgatcccaaatccttcctg

SEQ ID NO: 698690 - DNA, 25 bp, Rattus norvegicus
tttttccgatccgaaatccttcctg

SEQ ID NO: 698691 - DNA, 25 bp, Rattus norvegicus
tttttccgatgcagacttcaggtta

SEQ ID NO: 698692 - DNA, 25 bp, Rattus norvegicus
tttttccgatgctgacttcaggtta

SEQ ID NO: 698693 - DNA, 25 bp, Rattus norvegicus
tttttccgctttaatatggctgata

SEQ ID NO: 698694 - DNA, 25 bp, Rattus norvegicus
tttttccgcttttatatggctgata

SEQ ID NO: 698695 - DNA, 25 bp, Rattus norvegicus
tttttccgggagcagatcaccacct

SEQ ID NO: 698696 - DNA, 25 bp, Rattus norvegicus
tttttccgggaggagatcaccacct

SEQ ID NO: 698697 - DNA, 25 bp, Rattus norvegicus
tttttccgtctgagtgtgggctcca

SEQ ID NO: 698698 - DNA, 25 bp, Rattus norvegicus
tttttccgtctgtgtgtgggctcca

SEQ ID NO: 698699 - DNA, 25 bp, Rattus norvegicus
tttttccgtggccttgggtctacat

SEQ ID NO: 698700 - DNA, 25 bp, Rattus norvegicus
tttttccgtggcgttgggtctacat

SEQ ID NO: 698701 - DNA, 25 bp, Rattus norvegicus
tttttccgttaacagtattgcaatg

SEQ ID NO: 698702 - DNA, 25 bp, Rattus norvegicus
tttttccgttaagagtattgcaatg

SEQ ID NO: 698703 - DNA, 25 bp, Rattus norvegicus
tttttcctaccacttctatttcata

SEQ ID NO: 698704 - DNA, 25 bp, Rattus norvegicus
tttttcctaccagttctatttcata

SEQ ID NO: 698705 - DNA, 25 bp, Rattus norvegicus
tttttcctagaacttgtgttatgct

SEQ ID NO: 698706 - DNA, 25 bp, Rattus norvegicus
tttttcctagaagttgtgttatgct

SEQ ID NO: 698707 - DNA, 25 bp, Rattus norvegicus
tttttcctatctatttgggctcctg

SEQ ID NO: 698708 - DNA, 25 bp, Rattus norvegicus
tttttcctatctttttgggctcctg

SEQ ID NO: 698709 - DNA, 25 bp, Rattus norvegicus
tttttcctatgccttaccgaatatg

SEQ ID NO: 698710 - DNA, 25 bp, Rattus norvegicus
tttttcctatgcgttaccgaatatg

SEQ ID NO: 698711 - DNA, 25 bp, Rattus norvegicus
tttttcctcacaattctagaagtag

SEQ ID NO: 698712 - DNA, 25 bp, Rattus norvegicus
tttttcctcacatttctagaagtag

SEQ ID NO: 698713 - DNA, 25 bp, Rattus norvegicus
tttttcctcactatatccagtcttc

SEQ ID NO: 698714 - DNA, 25 bp, Rattus norvegicus
tttttcctcactttatccagtcttc

SEQ ID NO: 698715 - DNA, 25 bp, Rattus norvegicus
tttttcctcccaatagcaattttgg

SEQ ID NO: 698716 - DNA, 25 bp, Rattus norvegicus
tttttcctcccattagcaattttgg

SEQ ID NO: 698717 - DNA, 25 bp, Rattus norvegicus
tttttcctccctacaaggtcagaag

SEQ ID NO: 698718 - DNA, 25 bp, Rattus norvegicus
tttttcctcccttcaaggtcagaag

SEQ ID NO: 698719 - DNA, 25 bp, Rattus norvegicus
tttttcctcctgcagtctaactaca

SEQ ID NO: 698720 - DNA, 25 bp, Rattus norvegicus
tttttcctcctggagtctaactaca

SEQ ID NO: 698721 - DNA, 25 bp, Rattus norvegicus
tttttcctccttacaagtccatatg

SEQ ID NO: 698722 - DNA, 25 bp, Rattus norvegicus
tttttcctccttctgatgccgagga

SEQ ID NO: 698723 - DNA, 25 bp, Rattus norvegicus
tttttcctccttgtgatgccgagga

SEQ ID NO: 698724 - DNA, 25 bp, Rattus norvegicus
tttttcctcctttcaagtccatatg

SEQ ID NO: 698725 - DNA, 25 bp, Rattus norvegicus
tttttcctctcccttgatttcaaca

SEQ ID NO: 698726 - DNA, 25 bp, Rattus norvegicus
tttttcctctccgttgatttcaaca

SEQ ID NO: 698727 - DNA, 25 bp, Rattus norvegicus
tttttcctctggatcacagttcatg

SEQ ID NO: 698728 - DNA, 25 bp, Rattus norvegicus
tttttcctctggttcacagttcatg

SEQ ID NO: 698729 - DNA, 25 bp, Rattus norvegicus
tttttcctgagaatgttaccacgag

SEQ ID NO: 698730 - DNA, 25 bp, Rattus norvegicus
tttttcctgagattgttaccacgag

SEQ ID NO: 698731 - DNA, 25 bp, Rattus norvegicus
tttttcctggctacatttgaagctt

SEQ ID NO: 698732 - DNA, 25 bp, Rattus norvegicus
tttttcctggcttcatttgaagctt

SEQ ID NO: 698733 - DNA, 25 bp, Rattus norvegicus
tttttcctggtgcactgacttgcca

SEQ ID NO: 698734 - DNA, 25 bp, Rattus norvegicus
tttttcctggtggactgacttgcca

SEQ ID NO: 698735 - DNA, 25 bp, Rattus norvegicus
tttttcctgtctattgtggtccaag

SEQ ID NO: 698736 - DNA, 25 bp, Rattus norvegicus
tttttcctgtcttttgtggtccaag

SEQ ID NO: 698737 - DNA, 25 bp, Rattus norvegicus
tttttcctgttaatcactttcaaat

SEQ ID NO: 698738 - DNA, 25 bp, Rattus norvegicus
tttttcctgttattcactttcaaat

SEQ ID NO: 698739 - DNA, 25 bp, Rattus norvegicus
tttttccttcacattgttctggaat

SEQ ID NO: 698740 - DNA, 25 bp, Rattus norvegicus
tttttccttcactttgttctggaat

SEQ ID NO: 698741 - DNA, 25 bp, Rattus norvegicus
tttttccttctcattgagtcaggtt

SEQ ID NO: 698742 - DNA, 25 bp, Rattus norvegicus
tttttccttctctttgagtcaggtt

SEQ ID NO: 698743 - DNA, 25 bp, Rattus norvegicus
tttttccttctgagacctaacagcg

SEQ ID NO: 698744 - DNA, 25 bp, Rattus norvegicus
tttttccttctgtgacctaacagcg

SEQ ID NO: 698745 - DNA, 25 bp, Rattus norvegicus
tttttccttgccactaagtgctcct

SEQ ID NO: 698746 - DNA, 25 bp, Rattus norvegicus
tttttccttgcctctaagtgctcct

SEQ ID NO: 698747 - DNA, 25 bp, Rattus norvegicus
tttttccttggaatggtgcaaacaa

SEQ ID NO: 698748 - DNA, 25 bp, Rattus norvegicus
tttttccttggattggtgcaaacaa

SEQ ID NO: 698749 - DNA, 25 bp, Rattus norvegicus
tttttcctttatcagtacagtgtgt

SEQ ID NO: 698750 - DNA, 25 bp, Rattus norvegicus
tttttcctttatgagtacagtgtgt

SEQ ID NO: 698751 - DNA, 25 bp, Rattus norvegicus
tttttcctttctagaagcccgagtg

SEQ ID NO: 698752 - DNA, 25 bp, Rattus norvegicus
tttttcctttctatgcagtactcag

SEQ ID NO: 698753 - DNA, 25 bp, Rattus norvegicus
tttttcctttcttgaagcccgagtg

SEQ ID NO: 698754 - DNA, 25 bp, Rattus norvegicus
tttttcctttctttgcagtactcag

SEQ ID NO: 698755 - DNA, 25 bp, Rattus norvegicus
tttttcctttgcctgagtcctgaca

SEQ ID NO: 698756 - DNA, 25 bp, Rattus norvegicus
tttttcctttgcgtgagtcctgaca

SEQ ID NO: 698757 - DNA, 25 bp, Rattus norvegicus
tttttcctttgtctttccactaatg

SEQ ID NO: 698758 - DNA, 25 bp, Rattus norvegicus
tttttcctttgtgtttccactaatg

SEQ ID NO: 698759 - DNA, 25 bp, Rattus norvegicus
tttttcgaatctcaggaccaggtcc

SEQ ID NO: 698760 - DNA, 25 bp, Rattus norvegicus
tttttcgaatctgaggaccaggtcc

SEQ ID NO: 698761 - DNA, 25 bp, Rattus norvegicus
tttttcgacctcatcaatgctctaa

SEQ ID NO: 698762 - DNA, 25 bp, Rattus norvegicus
tttttcgacctcttcaatgctctaa

SEQ ID NO: 698763 - DNA, 25 bp, Rattus norvegicus
tttttcgcccagatgtcttggaaga

SEQ ID NO: 698764 - DNA, 25 bp, Rattus norvegicus
tttttcgcccagttgtcttggaaga

SEQ ID NO: 698765 - DNA, 25 bp, Rattus norvegicus
tttttcgcctgtatctacctaagac

SEQ ID NO: 698766 - DNA, 25 bp, Rattus norvegicus
tttttcgcctgtttctacctaagac

SEQ ID NO: 698767 - DNA, 25 bp, Rattus norvegicus
tttttcggagagatggttgcttctt

SEQ ID NO: 698768 - DNA, 25 bp, Rattus norvegicus
tttttcggagagttggttgcttctt

SEQ ID NO: 698769 - DNA, 25 bp, Rattus norvegicus
tttttcggcgatcggaggagcaccc

SEQ ID NO: 698770 - DNA, 25 bp, Rattus norvegicus
tttttcggcgatgggaggagcaccc

SEQ ID NO: 698771 - DNA, 25 bp, Rattus norvegicus
tttttcgtacttcttgacactgggc

SEQ ID NO: 698772 - DNA, 25 bp, Rattus norvegicus
tttttcgtacttgttgacactgggc

SEQ ID NO: 698773 - DNA, 25 bp, Rattus norvegicus
tttttcgtaggcagcgtggctccag

SEQ ID NO: 698774 - DNA, 25 bp, Rattus norvegicus
tttttcgtaggctgcgtggctccag

SEQ ID NO: 698775 - DNA, 25 bp, Rattus norvegicus
tttttcgtcctacctcagatttaag

SEQ ID NO: 698776 - DNA, 25 bp, Rattus norvegicus
tttttcgtcctagctcagatttaag

SEQ ID NO: 698777 - DNA, 25 bp, Rattus norvegicus
tttttcgtcggaaactaagtcatga

SEQ ID NO: 698778 - DNA, 25 bp, Rattus norvegicus
tttttcgtcggatactaagtcatga

SEQ ID NO: 698779 - DNA, 25 bp, Rattus norvegicus
tttttcgtctctacacatcacgcaa

SEQ ID NO: 698780 - DNA, 25 bp, Rattus norvegicus
tttttcgtctcttcacatcacgcaa

SEQ ID NO: 698781 - DNA, 25 bp, Rattus norvegicus
tttttcgtgaatcggctgacacttg

SEQ ID NO: 698782 - DNA, 25 bp, Rattus norvegicus
tttttcgtgaatgggctgacacttg

SEQ ID NO: 698783 - DNA, 25 bp, Rattus norvegicus
tttttctaacacaccttatcaagct

SEQ ID NO: 698784 - DNA, 25 bp, Rattus norvegicus
tttttctaacactccttatcaagct

SEQ ID NO: 698785 - DNA, 25 bp, Rattus norvegicus
tttttctagctgaatcttcctctct

SEQ ID NO: 698786 - DNA, 25 bp, Rattus norvegicus
tttttctagctgtatcttcctctct

SEQ ID NO: 698787 - DNA, 25 bp, Rattus norvegicus
tttttctataccatgcatgtgctac

SEQ ID NO: 698788 - DNA, 25 bp, Rattus norvegicus
tttttctataccttgcatgtgctac

SEQ ID NO: 698789 - DNA, 25 bp, Rattus norvegicus
tttttctatgacaatgccaccgtgc

SEQ ID NO: 698790 - DNA, 25 bp, Rattus norvegicus
tttttctatgactatgccaccgtgc

SEQ ID NO: 698791 - DNA, 25 bp, Rattus norvegicus
tttttctattctcccttttactttg

SEQ ID NO: 698792 - DNA, 25 bp, Rattus norvegicus
tttttctattctgccttttactttg

SEQ ID NO: 698793 - DNA, 25 bp, Rattus norvegicus
tttttctatttcactggagcacaat

SEQ ID NO: 698794 - DNA, 25 bp, Rattus norvegicus
tttttctatttctctggagcacaat

SEQ ID NO: 698795 - DNA, 25 bp, Rattus norvegicus
tttttctcaagcaccgactctgaaa

SEQ ID NO: 698796 - DNA, 25 bp, Rattus norvegicus
tttttctcaagctccgactctgaaa

SEQ ID NO: 698797 - DNA, 25 bp, Rattus norvegicus
tttttctcactgcatatttctggtc

SEQ ID NO: 698798 - DNA, 25 bp, Rattus norvegicus
tttttctcactggatatttctggtc

SEQ ID NO: 698799 - DNA, 25 bp, Rattus norvegicus
tttttctcatcccagttatccatgg

SEQ ID NO: 698800 - DNA, 25 bp, Rattus norvegicus
tttttctcatccgagttatccatgg

SEQ ID NO: 698801 - DNA, 25 bp, Rattus norvegicus
tttttctcccagcaaggccctgagg

SEQ ID NO: 698802 - DNA, 25 bp, Rattus norvegicus
tttttctcccagcttggttgccact

SEQ ID NO: 698803 - DNA, 25 bp, Rattus norvegicus
tttttctcccaggaaggccctgagg

SEQ ID NO: 698804 - DNA, 25 bp, Rattus norvegicus
tttttctcccaggttggttgccact

SEQ ID NO: 698805 - DNA, 25 bp, Rattus norvegicus
tttttctccccaatacagtgtttct

SEQ ID NO: 698806 - DNA, 25 bp, Rattus norvegicus
tttttctccccattacagtgtttct

SEQ ID NO: 698807 - DNA, 25 bp, Rattus norvegicus
tttttctcccctatatgctgtgata

SEQ ID NO: 698808 - DNA, 25 bp, Rattus norvegicus
tttttctcccctttatgctgtgata

SEQ ID NO: 698809 - DNA, 25 bp, Rattus norvegicus
tttttctccctcagactttactgac

SEQ ID NO: 698810 - DNA, 25 bp, Rattus norvegicus
tttttctccctctgactttactgac

SEQ ID NO: 698811 - DNA, 25 bp, Rattus norvegicus
tttttctcctccatgggccttggca

SEQ ID NO: 698812 - DNA, 25 bp, Rattus norvegicus
tttttctcctccttgggccttggca

SEQ ID NO: 698813 - DNA, 25 bp, Rattus norvegicus
tttttctcctggatgtgtttggaat

SEQ ID NO: 698814 - DNA, 25 bp, Rattus norvegicus
tttttctcctggttgtgtttggaat

SEQ ID NO: 698815 - DNA, 25 bp, Rattus norvegicus
tttttctctcaccactcaacaaatg

SEQ ID NO: 698816 - DNA, 25 bp, Rattus norvegicus
tttttctctcacgactcaacaaatg

SEQ ID NO: 698817 - DNA, 25 bp, Rattus norvegicus
tttttctctctgaaatgtatagcct

SEQ ID NO: 698818 - DNA, 25 bp, Rattus norvegicus
tttttctctctgtaatgtatagcct

SEQ ID NO: 698819 - DNA, 25 bp, Rattus norvegicus
tttttctctcttctcattcatcaaa

SEQ ID NO: 698820 - DNA, 25 bp, Rattus norvegicus
tttttctctcttgtcattcatcaaa

SEQ ID NO: 698821 - DNA, 25 bp, Rattus norvegicus
tttttctctgaccttttccatcctt

SEQ ID NO: 698822 - DNA, 25 bp, Rattus norvegicus
tttttctctgacgttttccatcctt

SEQ ID NO: 698823 - DNA, 25 bp, Rattus norvegicus
tttttctctgttatgcaaatattga

SEQ ID NO: 698824 - DNA, 25 bp, Rattus norvegicus
tttttctctgttttgcaaatattga

SEQ ID NO: 698825 - DNA, 25 bp, Rattus norvegicus
tttttctcttaaattctgctctggc

SEQ ID NO: 698826 - DNA, 25 bp, Rattus norvegicus
tttttctcttaatttctgctctggc

SEQ ID NO: 698827 - DNA, 25 bp, Rattus norvegicus
tttttctcttcaatctaactcctag

SEQ ID NO: 698828 - DNA, 25 bp, Rattus norvegicus
tttttctcttcattctaactcctag

SEQ ID NO: 698829 - DNA, 25 bp, Rattus norvegicus
tttttctctttcaaagccagggtct

SEQ ID NO: 698830 - DNA, 25 bp, Rattus norvegicus
tttttctctttctaagccagggtct

SEQ ID NO: 698831 - DNA, 25 bp, Rattus norvegicus
tttttctgaaatcgcccatctctgg

SEQ ID NO: 698832 - DNA, 25 bp, Rattus norvegicus
tttttctgaaatggcccatctctgg

SEQ ID NO: 698833 - DNA, 25 bp, Rattus norvegicus
tttttctgaattctagcttccctag

SEQ ID NO: 698834 - DNA, 25 bp, Rattus norvegicus
tttttctgaattgtagcttccctag

SEQ ID NO: 698835 - DNA, 25 bp, Rattus norvegicus
tttttctgacccagccatgtcacaa

SEQ ID NO: 698836 - DNA, 25 bp, Rattus norvegicus
tttttctgaccctgccatgtcacaa

SEQ ID NO: 698837 - DNA, 25 bp, Rattus norvegicus
tttttctgactgcatcatctcacct

SEQ ID NO: 698838 - DNA, 25 bp, Rattus norvegicus
tttttctgactggatcatctcacct

SEQ ID NO: 698839 - DNA, 25 bp, Rattus norvegicus
tttttctgacttagaggactctttg

SEQ ID NO: 698840 - DNA, 25 bp, Rattus norvegicus
tttttctgactttgaggactctttg

SEQ ID NO: 698841 - DNA, 25 bp, Rattus norvegicus
tttttctgctacattctcttatttg

SEQ ID NO: 698842 - DNA, 25 bp, Rattus norvegicus
tttttctgctactttctcttatttg

SEQ ID NO: 698843 - DNA, 25 bp, Rattus norvegicus
tttttctgctctcattttagcccat

SEQ ID NO: 698844 - DNA, 25 bp, Rattus norvegicus
tttttctgctctgattttagcccat

SEQ ID NO: 698845 - DNA, 25 bp, Rattus norvegicus
tttttctgctgacaccattgcaaaa

SEQ ID NO: 698846 - DNA, 25 bp, Rattus norvegicus
tttttctgctgagaccattgcaaaa

SEQ ID NO: 698847 - DNA, 25 bp, Rattus norvegicus
tttttctgcttcagaggctatgctc

SEQ ID NO: 698848 - DNA, 25 bp, Rattus norvegicus
tttttctgcttctgaggctatgctc

SEQ ID NO: 698849 - DNA, 25 bp, Rattus norvegicus
tttttctggatcatggctggaagtc

SEQ ID NO: 698850 - DNA, 25 bp, Rattus norvegicus
tttttctggatcttggctggaagtc

SEQ ID NO: 698851 - DNA, 25 bp, Rattus norvegicus
tttttctggctgattgcttttctca

SEQ ID NO: 698852 - DNA, 25 bp, Rattus norvegicus
tttttctggctgtttgcttttctca

SEQ ID NO: 698853 - DNA, 25 bp, Rattus norvegicus
tttttctgggcacgctgggccaaga

SEQ ID NO: 698854 - DNA, 25 bp, Rattus norvegicus
tttttctgggcaggctgggccaaga

SEQ ID NO: 698855 - DNA, 25 bp, Rattus norvegicus
tttttctgtaacaaatgcctgtttg

SEQ ID NO: 698856 - DNA, 25 bp, Rattus norvegicus
tttttctgtaactaatgcctgtttg

SEQ ID NO: 698857 - DNA, 25 bp, Rattus norvegicus
tttttctgtattcggtatgcggcac

SEQ ID NO: 698858 - DNA, 25 bp, Rattus norvegicus
tttttctgtattgggtatgcggcac

SEQ ID NO: 698859 - DNA, 25 bp, Rattus norvegicus
tttttctgtcccactgacacaaggg

SEQ ID NO: 698860 - DNA, 25 bp, Rattus norvegicus
tttttctgtcccattgtcgtctctt

SEQ ID NO: 698861 - DNA, 25 bp, Rattus norvegicus
tttttctgtccctctgacacaaggg

SEQ ID NO: 698862 - DNA, 25 bp, Rattus norvegicus
tttttctgtccctttgtcgtctctt

SEQ ID NO: 698863 - DNA, 25 bp, Rattus norvegicus
tttttctgtgcccaatgactaggct

SEQ ID NO: 698864 - DNA, 25 bp, Rattus norvegicus
tttttctgtgccgaatgactaggct

SEQ ID NO: 698865 - DNA, 25 bp, Rattus norvegicus
tttttctgtgtcaggctaatatttc

SEQ ID NO: 698866 - DNA, 25 bp, Rattus norvegicus
tttttctgtgtctggctaatatttc

SEQ ID NO: 698867 - DNA, 25 bp, Rattus norvegicus
tttttctgtttcctgcttagtggca

SEQ ID NO: 698868 - DNA, 25 bp, Rattus norvegicus
tttttctgtttcgtgcttagtggca

SEQ ID NO: 698869 - DNA, 25 bp, Rattus norvegicus
tttttcttacagctcttcagtcact

SEQ ID NO: 698870 - DNA, 25 bp, Rattus norvegicus
tttttcttacaggtcttcagtcact

SEQ ID NO: 698871 - DNA, 25 bp, Rattus norvegicus
tttttcttagccattttgtgccaat

SEQ ID NO: 698872 - DNA, 25 bp, Rattus norvegicus
tttttcttagcctttttgtgccaat

SEQ ID NO: 698873 - DNA, 25 bp, Rattus norvegicus
tttttcttagtgatgccctggccat

SEQ ID NO: 698874 - DNA, 25 bp, Rattus norvegicus
tttttcttagtgttgccctggccat

SEQ ID NO: 698875 - DNA, 25 bp, Rattus norvegicus
tttttcttcaaaaaagccatgccga

SEQ ID NO: 698876 - DNA, 25 bp, Rattus norvegicus
tttttcttcaaataagccatgccga

SEQ ID NO: 698877 - DNA, 25 bp, Rattus norvegicus
tttttcttcaagcttatcactgggc

SEQ ID NO: 698878 - DNA, 25 bp, Rattus norvegicus
tttttcttcaaggttatcactgggc

SEQ ID NO: 698879 - DNA, 25 bp, Rattus norvegicus
tttttcttcagacgccacgtctgcc

SEQ ID NO: 698880 - DNA, 25 bp, Rattus norvegicus
tttttcttcagaggccacgtctgcc

SEQ ID NO: 698881 - DNA, 25 bp, Rattus norvegicus
tttttcttcctcagtcaggtggatc

SEQ ID NO: 698882 - DNA, 25 bp, Rattus norvegicus
tttttcttcctctgtcaggtggatc

SEQ ID NO: 698883 - DNA, 25 bp, Rattus norvegicus
tttttcttctacataacctattcag

SEQ ID NO: 698884 - DNA, 25 bp, Rattus norvegicus
tttttcttctacttaacctattcag

SEQ ID NO: 698885 - DNA, 25 bp, Rattus norvegicus
tttttcttctctctcaatgtcacga

SEQ ID NO: 698886 - DNA, 25 bp, Rattus norvegicus
tttttcttctctgtcaatgtcacga

SEQ ID NO: 698887 - DNA, 25 bp, Rattus norvegicus
tttttcttgaggacacacttatgct

SEQ ID NO: 698888 - DNA, 25 bp, Rattus norvegicus
tttttcttgaggtcacacttatgct

SEQ ID NO: 698889 - DNA, 25 bp, Rattus norvegicus
tttttcttgatgatggttggaccct

SEQ ID NO: 698890 - DNA, 25 bp, Rattus norvegicus
tttttcttgatgttggttggaccct

SEQ ID NO: 698891 - DNA, 25 bp, Rattus norvegicus
tttttcttgattcaagctccctctg

SEQ ID NO: 698892 - DNA, 25 bp, Rattus norvegicus
tttttcttgattgaagctccctctg

SEQ ID NO: 698893 - DNA, 25 bp, Rattus norvegicus
tttttcttggagctgtttcatagga

SEQ ID NO: 698894 - DNA, 25 bp, Rattus norvegicus
tttttcttggaggtgtttcatagga

SEQ ID NO: 698895 - DNA, 25 bp, Rattus norvegicus
tttttctttaagactgtccccatca

SEQ ID NO: 698896 - DNA, 25 bp, Rattus norvegicus
tttttctttaagtctgtccccatca

SEQ ID NO: 698897 - DNA, 25 bp, Rattus norvegicus
tttttctttaggaagcgcgctggtc

SEQ ID NO: 698898 - DNA, 25 bp, Rattus norvegicus
tttttctttaggtagcgcgctggtc

SEQ ID NO: 698899 - DNA, 25 bp, Rattus norvegicus
tttttctttatcattggccctcatc

SEQ ID NO: 698900 - DNA, 25 bp, Rattus norvegicus
tttttctttatctttggccctcatc

SEQ ID NO: 698901 - DNA, 25 bp, Rattus norvegicus
tttttctttcagatgcacagggaat

SEQ ID NO: 698902 - DNA, 25 bp, Rattus norvegicus
tttttctttcagttgcacagggaat

SEQ ID NO: 698903 - DNA, 25 bp, Rattus norvegicus
tttttctttccactagcctctaaat

SEQ ID NO: 698904 - DNA, 25 bp, Rattus norvegicus
tttttctttccagtagcctctaaat

SEQ ID NO: 698905 - DNA, 25 bp, Rattus norvegicus
tttttctttgcccttattgtgatca

SEQ ID NO: 698906 - DNA, 25 bp, Rattus norvegicus
tttttctttgccgttattgtgatca

SEQ ID NO: 698907 - DNA, 25 bp, Rattus norvegicus
tttttctttgggaatgtctgacata

SEQ ID NO: 698908 - DNA, 25 bp, Rattus norvegicus
tttttctttgggtatgtctgacata

SEQ ID NO: 698909 - DNA, 25 bp, Rattus norvegicus
tttttcttttccacaccaagacatg

SEQ ID NO: 698910 - DNA, 25 bp, Rattus norvegicus
tttttcttttccaccactacataca

SEQ ID NO: 698911 - DNA, 25 bp, Rattus norvegicus
tttttcttttccatctcactccttt

SEQ ID NO: 698912 - DNA, 25 bp, Rattus norvegicus
tttttcttttcctcaccaagacatg

SEQ ID NO: 698913 - DNA, 25 bp, Rattus norvegicus
tttttcttttcctccactacataca

SEQ ID NO: 698914 - DNA, 25 bp, Rattus norvegicus
tttttcttttccttctcactccttt

SEQ ID NO: 698915 - DNA, 25 bp, Rattus norvegicus
tttttcttttgacttgttgactgag

SEQ ID NO: 698916 - DNA, 25 bp, Rattus norvegicus
tttttcttttgagttgttgactgag

SEQ ID NO: 698917 - DNA, 25 bp, Rattus norvegicus
tttttcttttttcggcagtgaatag

SEQ ID NO: 698918 - DNA, 25 bp, Rattus norvegicus
tttttcttttttgggcagtgaatag

SEQ ID NO: 698919 - DNA, 25 bp, Rattus norvegicus
tttttgaaactcaggccttacccag

SEQ ID NO: 698920 - DNA, 25 bp, Rattus norvegicus
tttttgaaactctggccttacccag

SEQ ID NO: 698921 - DNA, 25 bp, Rattus norvegicus
tttttgaaacttattgccgtgtatg

SEQ ID NO: 698922 - DNA, 25 bp, Rattus norvegicus
tttttgaaacttctcctgtcctgga

SEQ ID NO: 698923 - DNA, 25 bp, Rattus norvegicus
tttttgaaacttgtcctgtcctgga

SEQ ID NO: 698924 - DNA, 25 bp, Rattus norvegicus
tttttgaaactttttgccgtgtatg

SEQ ID NO: 698925 - DNA, 25 bp, Rattus norvegicus
tttttgaaccttatgagagctccag

SEQ ID NO: 698926 - DNA, 25 bp, Rattus norvegicus
tttttgaaccttttgagagctccag

SEQ ID NO: 698927 - DNA, 25 bp, Rattus norvegicus
tttttgaagtgtcggtctttctaat

SEQ ID NO: 698928 - DNA, 25 bp, Rattus norvegicus
tttttgaagtgtgggtctttctaat

SEQ ID NO: 698929 - DNA, 25 bp, Rattus norvegicus
tttttgacaaatccttcctccactg

SEQ ID NO: 698930 - DNA, 25 bp, Rattus norvegicus
tttttgacaaatgcttcctccactg

SEQ ID NO: 698931 - DNA, 25 bp, Rattus norvegicus
tttttgacatctattggcccttgca

SEQ ID NO: 698932 - DNA, 25 bp, Rattus norvegicus
tttttgacatcttttggcccttgca

SEQ ID NO: 698933 - DNA, 25 bp, Rattus norvegicus
tttttgaccgtcaccattaaggaga

SEQ ID NO: 698934 - DNA, 25 bp, Rattus norvegicus
tttttgaccgtctccattaaggaga

SEQ ID NO: 698935 - DNA, 25 bp, Rattus norvegicus
tttttgacctccaaataatgacaag

SEQ ID NO: 698936 - DNA, 25 bp, Rattus norvegicus
tttttgacctcctaataatgacaag

SEQ ID NO: 698937 - DNA, 25 bp, Rattus norvegicus
tttttgagaccaagtgccgagcccc

SEQ ID NO: 698938 - DNA, 25 bp, Rattus norvegicus
tttttgagaccatgtgccgagcccc

SEQ ID NO: 698939 - DNA, 25 bp, Rattus norvegicus
tttttgagaccgacccactatgtat

SEQ ID NO: 698940 - DNA, 25 bp, Rattus norvegicus
tttttgagaccgtcccactatgtat

SEQ ID NO: 698941 - DNA, 25 bp, Rattus norvegicus
tttttgagatcaattctgactgagt

SEQ ID NO: 698942 - DNA, 25 bp, Rattus norvegicus
tttttgagatcatttctgactgagt

SEQ ID NO: 698943 - DNA, 25 bp, Rattus norvegicus
tttttgagccatcggaggctcccca

SEQ ID NO: 698944 - DNA, 25 bp, Rattus norvegicus
tttttgagccatgggaggctcccca

SEQ ID NO: 698945 - DNA, 25 bp, Rattus norvegicus
tttttgagccgacccgagggctggg

SEQ ID NO: 698946 - DNA, 25 bp, Rattus norvegicus
tttttgagccgagccgagggctggg

SEQ ID NO: 698947 - DNA, 25 bp, Rattus norvegicus
tttttgagctgccactacacaggtt

SEQ ID NO: 698948 - DNA, 25 bp, Rattus norvegicus
tttttgagctgcgactacacaggtt

SEQ ID NO: 698949 - DNA, 25 bp, Rattus norvegicus
tttttgagctttctgggagtgcccc

SEQ ID NO: 698950 - DNA, 25 bp, Rattus norvegicus
tttttgagctttgtgggagtgcccc

SEQ ID NO: 698951 - DNA, 25 bp, Rattus norvegicus
tttttgaggccaacccaggatatgg

SEQ ID NO: 698952 - DNA, 25 bp, Rattus norvegicus
tttttgaggccatcccaggatatgg

SEQ ID NO: 698953 - DNA, 25 bp, Rattus norvegicus
tttttgaggctcatcataaattaaa

SEQ ID NO: 698954 - DNA, 25 bp, Rattus norvegicus
tttttgaggctcttcataaattaaa

SEQ ID NO: 698955 - DNA, 25 bp, Rattus norvegicus
tttttgagtgaacctggtgaaaagc

SEQ ID NO: 698956 - DNA, 25 bp, Rattus norvegicus
tttttgagtgaagctggtgaaaagc

SEQ ID NO: 698957 - DNA, 25 bp, Rattus norvegicus
tttttgagtgttagcctgggtgtct

SEQ ID NO: 698958 - DNA, 25 bp, Rattus norvegicus
tttttgagtgtttgcctgggtgtct

SEQ ID NO: 698959 - DNA, 25 bp, Rattus norvegicus
tttttgcaacttctgtgcatctgca

SEQ ID NO: 698960 - DNA, 25 bp, Rattus norvegicus
tttttgcaacttgtgtgcatctgca

SEQ ID NO: 698961 - DNA, 25 bp, Rattus norvegicus
tttttgcacgtaacgaaatggctag

SEQ ID NO: 698962 - DNA, 25 bp, Rattus norvegicus
tttttgcacgtatcgaaatggctag

SEQ ID NO: 698963 - DNA, 25 bp, Rattus norvegicus
tttttgcagagaaacgtgtacccat

SEQ ID NO: 698964 - DNA, 25 bp, Rattus norvegicus
tttttgcagagatacgtgtacccat

SEQ ID NO: 698965 - DNA, 25 bp, Rattus norvegicus
tttttgcagcccatggacctctcgg

SEQ ID NO: 698966 - DNA, 25 bp, Rattus norvegicus
tttttgcagcccttggacctctcgg

SEQ ID NO: 698967 - DNA, 25 bp, Rattus norvegicus
tttttgcagccgatagcatcaccac

SEQ ID NO: 698968 - DNA, 25 bp, Rattus norvegicus
tttttgcagccgttagcatcaccac

SEQ ID NO: 698969 - DNA, 25 bp, Rattus norvegicus
tttttgcaggctacattcccaggag

SEQ ID NO: 698970 - DNA, 25 bp, Rattus norvegicus
tttttgcaggcttcattcccaggag

SEQ ID NO: 698971 - DNA, 25 bp, Rattus norvegicus
tttttgcattccatacttgctgtac

SEQ ID NO: 698972 - DNA, 25 bp, Rattus norvegicus
tttttgcattccttacttgctgtac

SEQ ID NO: 698973 - DNA, 25 bp, Rattus norvegicus
tttttgcattgcatggttacagtct

SEQ ID NO: 698974 - DNA, 25 bp, Rattus norvegicus
tttttgcattgcttggttacagtct

SEQ ID NO: 698975 - DNA, 25 bp, Rattus norvegicus
tttttgccagcccaaccctggaaag

SEQ ID NO: 698976 - DNA, 25 bp, Rattus norvegicus
tttttgccagccgaaccctggaaag

SEQ ID NO: 698977 - DNA, 25 bp, Rattus norvegicus
tttttgccatgaaacctaggtgtaa

SEQ ID NO: 698978 - DNA, 25 bp, Rattus norvegicus
tttttgccatgatacctaggtgtaa

SEQ ID NO: 698979 - DNA, 25 bp, Rattus norvegicus
tttttgccattaatgtcatagctga

SEQ ID NO: 698980 - DNA, 25 bp, Rattus norvegicus
tttttgccattattgtcatagctga

SEQ ID NO: 698981 - DNA, 25 bp, Rattus norvegicus
tttttgcccaacatccctcaatgat

SEQ ID NO: 698982 - DNA, 25 bp, Rattus norvegicus
tttttgcccaacttccctcaatgat

SEQ ID NO: 698983 - DNA, 25 bp, Rattus norvegicus
tttttgccccttactacaccgagat

SEQ ID NO: 698984 - DNA, 25 bp, Rattus norvegicus
tttttgcccctttctacaccgagat

SEQ ID NO: 698985 - DNA, 25 bp, Rattus norvegicus
tttttgccgtgtatggagtcctaaa

SEQ ID NO: 698986 - DNA, 25 bp, Rattus norvegicus
tttttgccgtgtttggagtcctaaa

SEQ ID NO: 698987 - DNA, 25 bp, Rattus norvegicus
tttttgcctgcgattgaagaccata

SEQ ID NO: 698988 - DNA, 25 bp, Rattus norvegicus
tttttgcctgcgtttgaagaccata

SEQ ID NO: 698989 - DNA, 25 bp, Rattus norvegicus
tttttgcgtttgagggccccgcgca

SEQ ID NO: 698990 - DNA, 25 bp, Rattus norvegicus
tttttgcgtttgtgggccccgcgca

SEQ ID NO: 698991 - DNA, 25 bp, Rattus norvegicus
tttttgctacttacctacttacata

SEQ ID NO: 698992 - DNA, 25 bp, Rattus norvegicus
tttttgctactttcctacttacata

SEQ ID NO: 698993 - DNA, 25 bp, Rattus norvegicus
tttttgctcacactcctaaaggaag

SEQ ID NO: 698994 - DNA, 25 bp, Rattus norvegicus
tttttgctcacagtcctaaaggaag

SEQ ID NO: 698995 - DNA, 25 bp, Rattus norvegicus
tttttgctccatattctcatgctgt

SEQ ID NO: 698996 - DNA, 25 bp, Rattus norvegicus
tttttgctccattttctcatgctgt

SEQ ID NO: 698997 - DNA, 25 bp, Rattus norvegicus
tttttgctctctcctgtcaggacaa

SEQ ID NO: 698998 - DNA, 25 bp, Rattus norvegicus
tttttgctctctgctgtcaggacaa

SEQ ID NO: 698999 - DNA, 25 bp, Rattus norvegicus
tttttgctcttaactcctcggatcc

SEQ ID NO: 699000 - DNA, 25 bp, Rattus norvegicus
tttttgctcttatctcctcggatcc

SEQ ID NO: 699001 - DNA, 25 bp, Rattus norvegicus
tttttgctgaagaaccagtagccca

SEQ ID NO: 699002 - DNA, 25 bp, Rattus norvegicus
tttttgctgaagtaccagtagccca

SEQ ID NO: 699003 - DNA, 25 bp, Rattus norvegicus
tttttgctggctacaagcgaggcct

SEQ ID NO: 699004 - DNA, 25 bp, Rattus norvegicus
tttttgctggctagcactttcttat

SEQ ID NO: 699005 - DNA, 25 bp, Rattus norvegicus
tttttgctggcttcaagcgaggcct

SEQ ID NO: 699006 - DNA, 25 bp, Rattus norvegicus
tttttgctggcttgcactttcttat

SEQ ID NO: 699007 - DNA, 25 bp, Rattus norvegicus
tttttggaacccaggacgtctctga

SEQ ID NO: 699008 - DNA, 25 bp, Rattus norvegicus
tttttggaaccctggacgtctctga

SEQ ID NO: 699009 - DNA, 25 bp, Rattus norvegicus
tttttggagtttacctccgagctca

SEQ ID NO: 699010 - DNA, 25 bp, Rattus norvegicus
tttttggagttttcctccgagctca

SEQ ID NO: 699011 - DNA, 25 bp, Rattus norvegicus
tttttggatcaaatagcataaggag

SEQ ID NO: 699012 - DNA, 25 bp, Rattus norvegicus
tttttggatcaattagcataaggag

SEQ ID NO: 699013 - DNA, 25 bp, Rattus norvegicus
tttttggatcgtatcacttcagccc

SEQ ID NO: 699014 - DNA, 25 bp, Rattus norvegicus
tttttggatcgtttcacttcagccc

SEQ ID NO: 699015 - DNA, 25 bp, Rattus norvegicus
tttttggcagcgaagtctgccctat

SEQ ID NO: 699016 - DNA, 25 bp, Rattus norvegicus
tttttggcagcgtagtctgccctat

SEQ ID NO: 699017 - DNA, 25 bp, Rattus norvegicus
tttttggcccagaaagctgctacat

SEQ ID NO: 699018 - DNA, 25 bp, Rattus norvegicus
tttttggcccagtaagctgctacat

SEQ ID NO: 699019 - DNA, 25 bp, Rattus norvegicus
tttttggcccctctgcaagcaaatc

SEQ ID NO: 699020 - DNA, 25 bp, Rattus norvegicus
tttttggcccctgtgcaagcaaatc

SEQ ID NO: 699021 - DNA, 25 bp, Rattus norvegicus
tttttggccctgctgtgtgcttatc

SEQ ID NO: 699022 - DNA, 25 bp, Rattus norvegicus
tttttggccctggtgtgtgcttatc

SEQ ID NO: 699023 - DNA, 25 bp, Rattus norvegicus
tttttggccttcataacagccctgc

SEQ ID NO: 699024 - DNA, 25 bp, Rattus norvegicus
tttttggccttcttaacagccctgc

SEQ ID NO: 699025 - DNA, 25 bp, Rattus norvegicus
tttttggctcctcatcttagatttt

SEQ ID NO: 699026 - DNA, 25 bp, Rattus norvegicus
tttttggctcctgatcttagatttt

SEQ ID NO: 699027 - DNA, 25 bp, Rattus norvegicus
tttttgggagtcacatcattggcta

SEQ ID NO: 699028 - DNA, 25 bp, Rattus norvegicus
tttttgggagtctcatcattggcta

SEQ ID NO: 699029 - DNA, 25 bp, Rattus norvegicus
tttttgggcaaccacccagttctgg

SEQ ID NO: 699030 - DNA, 25 bp, Rattus norvegicus
tttttgggcaacgacccagttctgg

SEQ ID NO: 699031 - DNA, 25 bp, Rattus norvegicus
tttttgggcaggctctttccacata

SEQ ID NO: 699032 - DNA, 25 bp, Rattus norvegicus
tttttgggcagggtctttccacata

SEQ ID NO: 699033 - DNA, 25 bp, Rattus norvegicus
tttttgggctccacaggacaacata

SEQ ID NO: 699034 - DNA, 25 bp, Rattus norvegicus
tttttgggctcctcaggacaacata

SEQ ID NO: 699035 - DNA, 25 bp, Rattus norvegicus
tttttgggtcccagtccatcaccaa

SEQ ID NO: 699036 - DNA, 25 bp, Rattus norvegicus
tttttgggtccctgtccatcaccaa

SEQ ID NO: 699037 - DNA, 25 bp, Rattus norvegicus
tttttgggtgttctcttcacaggcc

SEQ ID NO: 699038 - DNA, 25 bp, Rattus norvegicus
tttttgggtgttgtcttcacaggcc

SEQ ID NO: 699039 - DNA, 25 bp, Rattus norvegicus
tttttggtcacacaacctaccacct

SEQ ID NO: 699040 - DNA, 25 bp, Rattus norvegicus
tttttggtcacagaacctaccacct

SEQ ID NO: 699041 - DNA, 25 bp, Rattus norvegicus
tttttggtccgacccttgatgttct

SEQ ID NO: 699042 - DNA, 25 bp, Rattus norvegicus
tttttggtccgagccttgatgttct

SEQ ID NO: 699043 - DNA, 25 bp, Rattus norvegicus
tttttggtctggctcttctgtcatc

SEQ ID NO: 699044 - DNA, 25 bp, Rattus norvegicus
tttttggtctgggtcttctgtcatc

SEQ ID NO: 699045 - DNA, 25 bp, Rattus norvegicus
tttttggtgatcagacctcagctcc

SEQ ID NO: 699046 - DNA, 25 bp, Rattus norvegicus
tttttggtgatctgacctcagctcc

SEQ ID NO: 699047 - DNA, 25 bp, Rattus norvegicus
tttttggtgggactagcatgtcact

SEQ ID NO: 699048 - DNA, 25 bp, Rattus norvegicus
tttttggtgggagtagcatgtcact

SEQ ID NO: 699049 - DNA, 25 bp, Rattus norvegicus
tttttggtgttactcgttccccatg

SEQ ID NO: 699050 - DNA, 25 bp, Rattus norvegicus
tttttggtgttagtcgttccccatg

SEQ ID NO: 699051 - DNA, 25 bp, Rattus norvegicus
tttttgtaaaccctcccatccacag

SEQ ID NO: 699052 - DNA, 25 bp, Rattus norvegicus
tttttgtaaaccgtcccatccacag

SEQ ID NO: 699053 - DNA, 25 bp, Rattus norvegicus
tttttgtaccaactgcagaccagtg

SEQ ID NO: 699054 - DNA, 25 bp, Rattus norvegicus
tttttgtaccaagtgcagaccagtg

SEQ ID NO: 699055 - DNA, 25 bp, Rattus norvegicus
tttttgtactgccagactgttgcct

SEQ ID NO: 699056 - DNA, 25 bp, Rattus norvegicus
tttttgtactgcgagactgttgcct

SEQ ID NO: 699057 - DNA, 25 bp, Rattus norvegicus
tttttgtaggccacagcagctcatt

SEQ ID NO: 699058 - DNA, 25 bp, Rattus norvegicus
tttttgtaggcctcagcagctcatt

SEQ ID NO: 699059 - DNA, 25 bp, Rattus norvegicus
tttttgtatgaaaccctcttcccat

SEQ ID NO: 699060 - DNA, 25 bp, Rattus norvegicus
tttttgtatgaatccctcttcccat

SEQ ID NO: 699061 - DNA, 25 bp, Rattus norvegicus
tttttgtattttccttgagatgcag

SEQ ID NO: 699062 - DNA, 25 bp, Rattus norvegicus
tttttgtattttgcttgagatgcag

SEQ ID NO: 699063 - DNA, 25 bp, Rattus norvegicus
tttttgtcaccactaagctcccaca

SEQ ID NO: 699064 - DNA, 25 bp, Rattus norvegicus
tttttgtcaccagtaagctcccaca

SEQ ID NO: 699065 - DNA, 25 bp, Rattus norvegicus
tttttgtcacgtcctttgaatccag

SEQ ID NO: 699066 - DNA, 25 bp, Rattus norvegicus
tttttgtcacgtgctttgaatccag

SEQ ID NO: 699067 - DNA, 25 bp, Rattus norvegicus
tttttgtcactgactcactatgtag

SEQ ID NO: 699068 - DNA, 25 bp, Rattus norvegicus
tttttgtcactgtctcactatgtag

SEQ ID NO: 699069 - DNA, 25 bp, Rattus norvegicus
tttttgtccaggaccaaggcactac

SEQ ID NO: 699070 - DNA, 25 bp, Rattus norvegicus
tttttgtccaggtccaaggcactac

SEQ ID NO: 699071 - DNA, 25 bp, Rattus norvegicus
tttttgtccatgaagttgagttcca

SEQ ID NO: 699072 - DNA, 25 bp, Rattus norvegicus
tttttgtccatgtagttgagttcca

SEQ ID NO: 699073 - DNA, 25 bp, Rattus norvegicus
tttttgtccgttcatagctttccac

SEQ ID NO: 699074 - DNA, 25 bp, Rattus norvegicus
tttttgtccgttgatagctttccac

SEQ ID NO: 699075 - DNA, 25 bp, Rattus norvegicus
tttttgtcctttaacctgccaggat

SEQ ID NO: 699076 - DNA, 25 bp, Rattus norvegicus
tttttgtccttttacctgccaggat

SEQ ID NO: 699077 - DNA, 25 bp, Rattus norvegicus
tttttgtctgtgctgccatcccagg

SEQ ID NO: 699078 - DNA, 25 bp, Rattus norvegicus
tttttgtctgtggtgccatcccagg

SEQ ID NO: 699079 - DNA, 25 bp, Rattus norvegicus
tttttgtgacacagggaacatctca

SEQ ID NO: 699080 - DNA, 25 bp, Rattus norvegicus
tttttgtgacactgggaacatctca

SEQ ID NO: 699081 - DNA, 25 bp, Rattus norvegicus
tttttgtgaccccaaatgcctgtgc

SEQ ID NO: 699082 - DNA, 25 bp, Rattus norvegicus
tttttgtgacccgaaatgcctgtgc

SEQ ID NO: 699083 - DNA, 25 bp, Rattus norvegicus
tttttgtgtctaaaagcacgctgaa

SEQ ID NO: 699084 - DNA, 25 bp, Rattus norvegicus
tttttgtgtctataagcacgctgaa

SEQ ID NO: 699085 - DNA, 25 bp, Rattus norvegicus
tttttgttagcactgcgccgtactt

SEQ ID NO: 699086 - DNA, 25 bp, Rattus norvegicus
tttttgttagcagtgcgccgtactt

SEQ ID NO: 699087 - DNA, 25 bp, Rattus norvegicus
tttttgttcgtaccccaaatgattg

SEQ ID NO: 699088 - DNA, 25 bp, Rattus norvegicus
tttttgttcgtagcccaaatgattg

SEQ ID NO: 699089 - DNA, 25 bp, Rattus norvegicus
tttttgttgctcagctcccaggaga

SEQ ID NO: 699090 - DNA, 25 bp, Rattus norvegicus
tttttgttgctctgctcccaggaga

SEQ ID NO: 699091 - DNA, 25 bp, Rattus norvegicus
tttttgttggccatgcgtcctacat

SEQ ID NO: 699092 - DNA, 25 bp, Rattus norvegicus
tttttgttggccttgcgtcctacat

SEQ ID NO: 699093 - DNA, 25 bp, Rattus norvegicus
tttttgtttattactgccttgactc

SEQ ID NO: 699094 - DNA, 25 bp, Rattus norvegicus
tttttgtttatttctgccttgactc

SEQ ID NO: 699095 - DNA, 25 bp, Rattus norvegicus
tttttgtttcttcctggaacagaag

SEQ ID NO: 699096 - DNA, 25 bp, Rattus norvegicus
tttttgtttcttgctggaacagaag

SEQ ID NO: 699097 - DNA, 25 bp, Rattus norvegicus
tttttgttttctaagccagtgggca

SEQ ID NO: 699098 - DNA, 25 bp, Rattus norvegicus
tttttgttttcttagccagtgggca

SEQ ID NO: 699099 - DNA, 25 bp, Rattus norvegicus
ttttttaaacatccagtctcccagc

SEQ ID NO: 699100 - DNA, 25 bp, Rattus norvegicus
ttttttaaacatgcagtctcccagc

SEQ ID NO: 699101 - DNA, 25 bp, Rattus norvegicus
ttttttaaacttatgcccagaggct

SEQ ID NO: 699102 - DNA, 25 bp, Rattus norvegicus
ttttttaaacttttgcccagaggct

SEQ ID NO: 699103 - DNA, 25 bp, Rattus norvegicus
ttttttaaagcgctctctcttcctc

SEQ ID NO: 699104 - DNA, 25 bp, Rattus norvegicus
ttttttaaagcggtctctcttcctc

SEQ ID NO: 699105 - DNA, 25 bp, Rattus norvegicus
ttttttaaagctccatgcccggctt

SEQ ID NO: 699106 - DNA, 25 bp, Rattus norvegicus
ttttttaaagctgcatgcccggctt

SEQ ID NO: 699107 - DNA, 25 bp, Rattus norvegicus
ttttttaacattatcgctccccatg

SEQ ID NO: 699108 - DNA, 25 bp, Rattus norvegicus
ttttttaacattttcgctccccatg

SEQ ID NO: 699109 - DNA, 25 bp, Rattus norvegicus
ttttttaaccatcgctgccagacag

SEQ ID NO: 699110 - DNA, 25 bp, Rattus norvegicus
ttttttaaccatggctgccagacag

SEQ ID NO: 699111 - DNA, 25 bp, Rattus norvegicus
ttttttaactctcggcttagctgtg

SEQ ID NO: 699112 - DNA, 25 bp, Rattus norvegicus
ttttttaactctgggcttagctgtg

SEQ ID NO: 699113 - DNA, 25 bp, Rattus norvegicus
ttttttaactgtctggccttccata

SEQ ID NO: 699114 - DNA, 25 bp, Rattus norvegicus
ttttttaactgtgtggccttccata

SEQ ID NO: 699115 - DNA, 25 bp, Rattus norvegicus
ttttttaagaccatgggagaccaca

SEQ ID NO: 699116 - DNA, 25 bp, Rattus norvegicus
ttttttaagaccttgggagaccaca

SEQ ID NO: 699117 - DNA, 25 bp, Rattus norvegicus
ttttttaatcccctagtcttgtctg

SEQ ID NO: 699118 - DNA, 25 bp, Rattus norvegicus
ttttttaatcccgtagtcttgtctg

SEQ ID NO: 699119 - DNA, 25 bp, Rattus norvegicus
ttttttaatgtgagccctgtagggt

SEQ ID NO: 699120 - DNA, 25 bp, Rattus norvegicus
ttttttaatgtgtgccctgtagggt

SEQ ID NO: 699121 - DNA, 25 bp, Rattus norvegicus
ttttttaattgcctgcttctcccca

SEQ ID NO: 699122 - DNA, 25 bp, Rattus norvegicus
ttttttaattgcgtgcttctcccca

SEQ ID NO: 699123 - DNA, 25 bp, Rattus norvegicus
ttttttacacttctgtccctggtca

SEQ ID NO: 699124 - DNA, 25 bp, Rattus norvegicus
ttttttacacttgtgtccctggtca

SEQ ID NO: 699125 - DNA, 25 bp, Rattus norvegicus
ttttttacagacacactcaccacaa

SEQ ID NO: 699126 - DNA, 25 bp, Rattus norvegicus
ttttttacagactcactcaccacaa

SEQ ID NO: 699127 - DNA, 25 bp, Rattus norvegicus
ttttttaccatccatcctgtgcaat

SEQ ID NO: 699128 - DNA, 25 bp, Rattus norvegicus
ttttttaccatcgatcctgtgcaat

SEQ ID NO: 699129 - DNA, 25 bp, Rattus norvegicus
ttttttacctttccgtctgatgcta

SEQ ID NO: 699130 - DNA, 25 bp, Rattus norvegicus
ttttttacctttgcgtctgatgcta

SEQ ID NO: 699131 - DNA, 25 bp, Rattus norvegicus
ttttttactcccctttgatgccata

SEQ ID NO: 699132 - DNA, 25 bp, Rattus norvegicus
ttttttactcccgtttgatgccata

SEQ ID NO: 699133 - DNA, 25 bp, Rattus norvegicus
ttttttagacagagccacaaggaga

SEQ ID NO: 699134 - DNA, 25 bp, Rattus norvegicus
ttttttagacagtgccacaaggaga

SEQ ID NO: 699135 - DNA, 25 bp, Rattus norvegicus
ttttttagcaccacaccagacataa

SEQ ID NO: 699136 - DNA, 25 bp, Rattus norvegicus
ttttttagcacctcaccagacataa

SEQ ID NO: 699137 - DNA, 25 bp, Rattus norvegicus
ttttttagtctgaagcccatgccac

SEQ ID NO: 699138 - DNA, 25 bp, Rattus norvegicus
ttttttagtctgtagcccatgccac

SEQ ID NO: 699139 - DNA, 25 bp, Rattus norvegicus
ttttttagtgctagcatctcttcct

SEQ ID NO: 699140 - DNA, 25 bp, Rattus norvegicus
ttttttagtgcttgcatctcttcct

SEQ ID NO: 699141 - DNA, 25 bp, Rattus norvegicus
ttttttatagcccaatcatctagta

SEQ ID NO: 699142 - DNA, 25 bp, Rattus norvegicus
ttttttatagccgaatcatctagta

SEQ ID NO: 699143 - DNA, 25 bp, Rattus norvegicus
ttttttatcaatccttagtgaccta

SEQ ID NO: 699144 - DNA, 25 bp, Rattus norvegicus
ttttttatcaatgcttagtgaccta

SEQ ID NO: 699145 - DNA, 25 bp, Rattus norvegicus
ttttttatcggaaggtcacgccctg

SEQ ID NO: 699146 - DNA, 25 bp, Rattus norvegicus
ttttttatcggatggtcacgccctg

SEQ ID NO: 699147 - DNA, 25 bp, Rattus norvegicus
ttttttatcgtcatgcctgccatct

SEQ ID NO: 699148 - DNA, 25 bp, Rattus norvegicus
ttttttatcgtcttgcctgccatct

SEQ ID NO: 699149 - DNA, 25 bp, Rattus norvegicus
ttttttatgaatctgcgggctgact

SEQ ID NO: 699150 - DNA, 25 bp, Rattus norvegicus
ttttttatgaatgtgcgggctgact

SEQ ID NO: 699151 - DNA, 25 bp, Rattus norvegicus
ttttttatggttacacagctctgcc

SEQ ID NO: 699152 - DNA, 25 bp, Rattus norvegicus
ttttttatggtttcacagctctgcc

SEQ ID NO: 699153 - DNA, 25 bp, Rattus norvegicus
ttttttattcttctgtttttctatg

SEQ ID NO: 699154 - DNA, 25 bp, Rattus norvegicus
ttttttattcttgtgtttttctatg

SEQ ID NO: 699155 - DNA, 25 bp, Rattus norvegicus
ttttttatttccagttagatcgtga

SEQ ID NO: 699156 - DNA, 25 bp, Rattus norvegicus
ttttttatttcctgttagatcgtga

SEQ ID NO: 699157 - DNA, 25 bp, Rattus norvegicus
ttttttcaaaacactgcttcagcaa

SEQ ID NO: 699158 - DNA, 25 bp, Rattus norvegicus
ttttttcaaaactctgcttcagcaa

SEQ ID NO: 699159 - DNA, 25 bp, Rattus norvegicus
ttttttcaaaccactgaatgcggag

SEQ ID NO: 699160 - DNA, 25 bp, Rattus norvegicus
ttttttcaaacctctgaatgcggag

SEQ ID NO: 699161 - DNA, 25 bp, Rattus norvegicus
ttttttcaaagtatcctgcgaggag

SEQ ID NO: 699162 - DNA, 25 bp, Rattus norvegicus
ttttttcaaagtttcctgcgaggag

SEQ ID NO: 699163 - DNA, 25 bp, Rattus norvegicus
ttttttcaaccaaagcattgctgta

SEQ ID NO: 699164 - DNA, 25 bp, Rattus norvegicus
ttttttcaaccatagcattgctgta

SEQ ID NO: 699165 - DNA, 25 bp, Rattus norvegicus
ttttttcaactcaccatcaaatgtg

SEQ ID NO: 699166 - DNA, 25 bp, Rattus norvegicus
ttttttcaactctccatcaaatgtg

SEQ ID NO: 699167 - DNA, 25 bp, Rattus norvegicus
ttttttcaatcaagcccatatgaaa

SEQ ID NO: 699168 - DNA, 25 bp, Rattus norvegicus
ttttttcaatcatgcccatatgaaa

SEQ ID NO: 699169 - DNA, 25 bp, Rattus norvegicus
ttttttcacacaaaagccaccattt

SEQ ID NO: 699170 - DNA, 25 bp, Rattus norvegicus
ttttttcacacataagccaccattt

SEQ ID NO: 699171 - DNA, 25 bp, Rattus norvegicus
ttttttcactgcaaccctaatgtcc

SEQ ID NO: 699172 - DNA, 25 bp, Rattus norvegicus
ttttttcactgctaccctaatgtcc

SEQ ID NO: 699173 - DNA, 25 bp, Rattus norvegicus
ttttttcagacaacctcagtgccta

SEQ ID NO: 699174 - DNA, 25 bp, Rattus norvegicus
ttttttcagacatcctcagtgccta

SEQ ID NO: 699175 - DNA, 25 bp, Rattus norvegicus
ttttttcagtgcattctgggaatgt

SEQ ID NO: 699176 - DNA, 25 bp, Rattus norvegicus
ttttttcagtgctttctgggaatgt

SEQ ID NO: 699177 - DNA, 25 bp, Rattus norvegicus
ttttttcatataaccctcactcaca

SEQ ID NO: 699178 - DNA, 25 bp, Rattus norvegicus
ttttttcatatatccctcactcaca

SEQ ID NO: 699179 - DNA, 25 bp, Rattus norvegicus
ttttttcatattattgtggatcact

SEQ ID NO: 699180 - DNA, 25 bp, Rattus norvegicus
ttttttcatatttttgtggatcact

SEQ ID NO: 699181 - DNA, 25 bp, Rattus norvegicus
ttttttcatccacaacttcagggag

SEQ ID NO: 699182 - DNA, 25 bp, Rattus norvegicus
ttttttcatccagaacttcagggag

SEQ ID NO: 699183 - DNA, 25 bp, Rattus norvegicus
ttttttcatctgcaggtgccatttt

SEQ ID NO: 699184 - DNA, 25 bp, Rattus norvegicus
ttttttcatctggaggtgccatttt

SEQ ID NO: 699185 - DNA, 25 bp, Rattus norvegicus
ttttttcatggcagttctatacaaa

SEQ ID NO: 699186 - DNA, 25 bp, Rattus norvegicus
ttttttcatggctgttctatacaaa

SEQ ID NO: 699187 - DNA, 25 bp, Rattus norvegicus
ttttttcattcacttacccatggaa

SEQ ID NO: 699188 - DNA, 25 bp, Rattus norvegicus
ttttttcattcagttacccatggaa

SEQ ID NO: 699189 - DNA, 25 bp, Rattus norvegicus
ttttttccaacaagctgggcctttg

SEQ ID NO: 699190 - DNA, 25 bp, Rattus norvegicus
ttttttccaacatgctgggcctttg

SEQ ID NO: 699191 - DNA, 25 bp, Rattus norvegicus
ttttttccaacgctcgggaggctgg

SEQ ID NO: 699192 - DNA, 25 bp, Rattus norvegicus
ttttttccaacggtcgggaggctgg

SEQ ID NO: 699193 - DNA, 25 bp, Rattus norvegicus
ttttttccaatacagattcccttct

SEQ ID NO: 699194 - DNA, 25 bp, Rattus norvegicus
ttttttccaatactacggcagtgct

SEQ ID NO: 699195 - DNA, 25 bp, Rattus norvegicus
ttttttccaatagagattcccttct

SEQ ID NO: 699196 - DNA, 25 bp, Rattus norvegicus
ttttttccaatagtacggcagtgct

SEQ ID NO: 699197 - DNA, 25 bp, Rattus norvegicus
ttttttccaccaactgcaggagata

SEQ ID NO: 699198 - DNA, 25 bp, Rattus norvegicus
ttttttccaccatctgcaggagata

SEQ ID NO: 699199 - DNA, 25 bp, Rattus norvegicus
ttttttccacctcttgattctcaaa

SEQ ID NO: 699200 - DNA, 25 bp, Rattus norvegicus
ttttttccacctgttgattctcaaa

SEQ ID NO: 699201 - DNA, 25 bp, Rattus norvegicus
ttttttccactcatctgtatgttgt

SEQ ID NO: 699202 - DNA, 25 bp, Rattus norvegicus
ttttttccactcttctgtatgttgt

SEQ ID NO: 699203 - DNA, 25 bp, Rattus norvegicus
ttttttccagctcaaagctctcaca

SEQ ID NO: 699204 - DNA, 25 bp, Rattus norvegicus
ttttttccagctgaaagctctcaca

SEQ ID NO: 699205 - DNA, 25 bp, Rattus norvegicus
ttttttccaggcaggttcaggtctg

SEQ ID NO: 699206 - DNA, 25 bp, Rattus norvegicus
ttttttccaggctggttcaggtctg

SEQ ID NO: 699207 - DNA, 25 bp, Rattus norvegicus
ttttttccaggtcaggagcctcagc

SEQ ID NO: 699208 - DNA, 25 bp, Rattus norvegicus
ttttttccaggtgaggagcctcagc

SEQ ID NO: 699209 - DNA, 25 bp, Rattus norvegicus
ttttttccagtgagtcatccacagc

SEQ ID NO: 699210 - DNA, 25 bp, Rattus norvegicus
ttttttccagtgtgtcatccacagc

SEQ ID NO: 699211 - DNA, 25 bp, Rattus norvegicus
ttttttccagttatatcccagatca

SEQ ID NO: 699212 - DNA, 25 bp, Rattus norvegicus
ttttttccagttttatcccagatca

SEQ ID NO: 699213 - DNA, 25 bp, Rattus norvegicus
ttttttccatctacagttgtctctg

SEQ ID NO: 699214 - DNA, 25 bp, Rattus norvegicus
ttttttccatcttcagttgtctctg

SEQ ID NO: 699215 - DNA, 25 bp, Rattus norvegicus
ttttttccatttccacagcactgaa

SEQ ID NO: 699216 - DNA, 25 bp, Rattus norvegicus
ttttttccatttgcacagcactgaa

SEQ ID NO: 699217 - DNA, 25 bp, Rattus norvegicus
ttttttcccaagacagtgcccagta

SEQ ID NO: 699218 - DNA, 25 bp, Rattus norvegicus
ttttttcccaagtcagtgcccagta

SEQ ID NO: 699219 - DNA, 25 bp, Rattus norvegicus
ttttttcccaatctgtaggttgcca

SEQ ID NO: 699220 - DNA, 25 bp, Rattus norvegicus
ttttttcccaatgtgtaggttgcca

SEQ ID NO: 699221 - DNA, 25 bp, Rattus norvegicus
ttttttcccagaatcgtcacaatgc

SEQ ID NO: 699222 - DNA, 25 bp, Rattus norvegicus
ttttttcccagattcgtcacaatgc

SEQ ID NO: 699223 - DNA, 25 bp, Rattus norvegicus
ttttttcccatcacttgttgccaca

SEQ ID NO: 699224 - DNA, 25 bp, Rattus norvegicus
ttttttcccatctcttgttgccaca

SEQ ID NO: 699225 - DNA, 25 bp, Rattus norvegicus
ttttttccccaacacttgtgagcaa

SEQ ID NO: 699226 - DNA, 25 bp, Rattus norvegicus
ttttttccccaagacttgtgagcaa

SEQ ID NO: 699227 - DNA, 25 bp, Rattus norvegicus
ttttttcccctgattttctcaagat

SEQ ID NO: 699228 - DNA, 25 bp, Rattus norvegicus
ttttttcccctgtttttctcaagat

SEQ ID NO: 699229 - DNA, 25 bp, Rattus norvegicus
ttttttccctctacttacatgtatt

SEQ ID NO: 699230 - DNA, 25 bp, Rattus norvegicus
ttttttccctctcagtgcattcaga

SEQ ID NO: 699231 - DNA, 25 bp, Rattus norvegicus
ttttttccctctgagtgcattcaga

SEQ ID NO: 699232 - DNA, 25 bp, Rattus norvegicus
ttttttccctcttcttacatgtatt

SEQ ID NO: 699233 - DNA, 25 bp, Rattus norvegicus
ttttttccctgtcactgaatatggg

SEQ ID NO: 699234 - DNA, 25 bp, Rattus norvegicus
ttttttccctgtgactgaatatggg

SEQ ID NO: 699235 - DNA, 25 bp, Rattus norvegicus
ttttttccctttcctcaggcacctg

SEQ ID NO: 699236 - DNA, 25 bp, Rattus norvegicus
ttttttccctttgctcaggcacctg

SEQ ID NO: 699237 - DNA, 25 bp, Rattus norvegicus
ttttttccgcagctgtaccgtctaa

SEQ ID NO: 699238 - DNA, 25 bp, Rattus norvegicus
ttttttccgcaggtgtaccgtctaa

SEQ ID NO: 699239 - DNA, 25 bp, Rattus norvegicus
ttttttccgcttctaatctttgtat

SEQ ID NO: 699240 - DNA, 25 bp, Rattus norvegicus
ttttttccgcttgtaatctttgtat

SEQ ID NO: 699241 - DNA, 25 bp, Rattus norvegicus
ttttttcctaccaatttgtaatgag

SEQ ID NO: 699242 - DNA, 25 bp, Rattus norvegicus
ttttttcctacctatttgtaatgag

SEQ ID NO: 699243 - DNA, 25 bp, Rattus norvegicus
ttttttcctagcagtggttcgcagg

SEQ ID NO: 699244 - DNA, 25 bp, Rattus norvegicus
ttttttcctagctgtggttcgcagg

SEQ ID NO: 699245 - DNA, 25 bp, Rattus norvegicus
ttttttcctatgcttagctgacaac

SEQ ID NO: 699246 - DNA, 25 bp, Rattus norvegicus
ttttttcctatggttagctgacaac

SEQ ID NO: 699247 - DNA, 25 bp, Rattus norvegicus
ttttttcctcatctggtagacgtca

SEQ ID NO: 699248 - DNA, 25 bp, Rattus norvegicus
ttttttcctcatgtggtagacgtca

SEQ ID NO: 699249 - DNA, 25 bp, Rattus norvegicus
ttttttcctcccctagcagtcattc

SEQ ID NO: 699250 - DNA, 25 bp, Rattus norvegicus
ttttttcctcccgtagcagtcattc

SEQ ID NO: 699251 - DNA, 25 bp, Rattus norvegicus
ttttttcctcctaagccaatgcggc

SEQ ID NO: 699252 - DNA, 25 bp, Rattus norvegicus
ttttttcctcctcgcagtaaggaga

SEQ ID NO: 699253 - DNA, 25 bp, Rattus norvegicus
ttttttcctcctggcagtaaggaga

SEQ ID NO: 699254 - DNA, 25 bp, Rattus norvegicus
ttttttcctccttagccaatgcggc

SEQ ID NO: 699255 - DNA, 25 bp, Rattus norvegicus
ttttttcctctcaagttgcagcatg

SEQ ID NO: 699256 - DNA, 25 bp, Rattus norvegicus
ttttttcctctctagttgcagcatg

SEQ ID NO: 699257 - DNA, 25 bp, Rattus norvegicus
ttttttcctctgagtacggactcag

SEQ ID NO: 699258 - DNA, 25 bp, Rattus norvegicus
ttttttcctctgtgtacggactcag

SEQ ID NO: 699259 - DNA, 25 bp, Rattus norvegicus
ttttttcctgacacactaaccacat

SEQ ID NO: 699260 - DNA, 25 bp, Rattus norvegicus
ttttttcctgactcactaaccacat

SEQ ID NO: 699261 - DNA, 25 bp, Rattus norvegicus
ttttttcctgcacaactgttgtctg

SEQ ID NO: 699262 - DNA, 25 bp, Rattus norvegicus
ttttttcctgcacctggggcactct

SEQ ID NO: 699263 - DNA, 25 bp, Rattus norvegicus
ttttttcctgcaccttgagcaaact

SEQ ID NO: 699264 - DNA, 25 bp, Rattus norvegicus
ttttttcctgcagaactgttgtctg

SEQ ID NO: 699265 - DNA, 25 bp, Rattus norvegicus
ttttttcctgcagctggggcactct

SEQ ID NO: 699266 - DNA, 25 bp, Rattus norvegicus
ttttttcctgcagcttgagcaaact

SEQ ID NO: 699267 - DNA, 25 bp, Rattus norvegicus
ttttttcctgccattaagccattct

SEQ ID NO: 699268 - DNA, 25 bp, Rattus norvegicus
ttttttcctgcctttaagccattct

SEQ ID NO: 699269 - DNA, 25 bp, Rattus norvegicus
ttttttcctgtaatgctttgctcat

SEQ ID NO: 699270 - DNA, 25 bp, Rattus norvegicus
ttttttcctgtattgctttgctcat

SEQ ID NO: 699271 - DNA, 25 bp, Rattus norvegicus
ttttttcctgtccttgacatttggt

SEQ ID NO: 699272 - DNA, 25 bp, Rattus norvegicus
ttttttcctgtcgttgacatttggt

SEQ ID NO: 699273 - DNA, 25 bp, Rattus norvegicus
ttttttccttctacctgttccatct

SEQ ID NO: 699274 - DNA, 25 bp, Rattus norvegicus
ttttttccttctattgccatctcac

SEQ ID NO: 699275 - DNA, 25 bp, Rattus norvegicus
ttttttccttcttcctgttccatct

SEQ ID NO: 699276 - DNA, 25 bp, Rattus norvegicus
ttttttccttcttttgccatctcac

SEQ ID NO: 699277 - DNA, 25 bp, Rattus norvegicus
ttttttccttgcactgagtgacctc

SEQ ID NO: 699278 - DNA, 25 bp, Rattus norvegicus
ttttttccttgctctgagtgacctc

SEQ ID NO: 699279 - DNA, 25 bp, Rattus norvegicus
ttttttcgctagctttggcaattta

SEQ ID NO: 699280 - DNA, 25 bp, Rattus norvegicus
ttttttcgctaggtttggcaattta

SEQ ID NO: 699281 - DNA, 25 bp, Rattus norvegicus
ttttttcgctgacaacaccaaggga

SEQ ID NO: 699282 - DNA, 25 bp, Rattus norvegicus
ttttttcgctgagaacaccaaggga

SEQ ID NO: 699283 - DNA, 25 bp, Rattus norvegicus
ttttttcgtgagctttgtggctaat

SEQ ID NO: 699284 - DNA, 25 bp, Rattus norvegicus
ttttttcgtgaggtttgtggctaat

SEQ ID NO: 699285 - DNA, 25 bp, Rattus norvegicus
ttttttctaagactcccagagaatg

SEQ ID NO: 699286 - DNA, 25 bp, Rattus norvegicus
ttttttctaagagtcccagagaatg

SEQ ID NO: 699287 - DNA, 25 bp, Rattus norvegicus
ttttttctaataaccattgtgatca

SEQ ID NO: 699288 - DNA, 25 bp, Rattus norvegicus
ttttttctaatatccattgtgatca

SEQ ID NO: 699289 - DNA, 25 bp, Rattus norvegicus
ttttttctacatacacagccatatt

SEQ ID NO: 699290 - DNA, 25 bp, Rattus norvegicus
ttttttctacatattactctctgaa

SEQ ID NO: 699291 - DNA, 25 bp, Rattus norvegicus
ttttttctacatctgaactttttgt

SEQ ID NO: 699292 - DNA, 25 bp, Rattus norvegicus
ttttttctacatgtgaactttttgt

SEQ ID NO: 699293 - DNA, 25 bp, Rattus norvegicus
ttttttctacattcacagccatatt

SEQ ID NO: 699294 - DNA, 25 bp, Rattus norvegicus
ttttttctacattttactctctgaa

SEQ ID NO: 699295 - DNA, 25 bp, Rattus norvegicus
ttttttctaccaaaagtgacaccaa

SEQ ID NO: 699296 - DNA, 25 bp, Rattus norvegicus
ttttttctaccataagtgacaccaa

SEQ ID NO: 699297 - DNA, 25 bp, Rattus norvegicus
ttttttctactaccttctgtacaaa

SEQ ID NO: 699298 - DNA, 25 bp, Rattus norvegicus
ttttttctactagcttctgtacaaa

SEQ ID NO: 699299 - DNA, 25 bp, Rattus norvegicus
ttttttctactcaagcgtggtggct

SEQ ID NO: 699300 - DNA, 25 bp, Rattus norvegicus
ttttttctactctagcgtggtggct

SEQ ID NO: 699301 - DNA, 25 bp, Rattus norvegicus
ttttttctagtaccttcctgggact

SEQ ID NO: 699302 - DNA, 25 bp, Rattus norvegicus
ttttttctagtagcttcctgggact

SEQ ID NO: 699303 - DNA, 25 bp, Rattus norvegicus
ttttttctagttcattcagagacat

SEQ ID NO: 699304 - DNA, 25 bp, Rattus norvegicus
ttttttctagttgattcagagacat

SEQ ID NO: 699305 - DNA, 25 bp, Rattus norvegicus
ttttttctatggcacctccaggcca

SEQ ID NO: 699306 - DNA, 25 bp, Rattus norvegicus
ttttttctatgggacctccaggcca

SEQ ID NO: 699307 - DNA, 25 bp, Rattus norvegicus
ttttttctcataattgccaagccaa

SEQ ID NO: 699308 - DNA, 25 bp, Rattus norvegicus
ttttttctcataccactaaccagct

SEQ ID NO: 699309 - DNA, 25 bp, Rattus norvegicus
ttttttctcatagcactaaccagct

SEQ ID NO: 699310 - DNA, 25 bp, Rattus norvegicus
ttttttctcatatttgccaagccaa

SEQ ID NO: 699311 - DNA, 25 bp, Rattus norvegicus
ttttttctccaccagtcttaaatgg

SEQ ID NO: 699312 - DNA, 25 bp, Rattus norvegicus
ttttttctccacgagtcttaaatgg

SEQ ID NO: 699313 - DNA, 25 bp, Rattus norvegicus
ttttttctccagagttctttcatac

SEQ ID NO: 699314 - DNA, 25 bp, Rattus norvegicus
ttttttctccagtgttctttcatac

SEQ ID NO: 699315 - DNA, 25 bp, Rattus norvegicus
ttttttctccccagttgtcatcgtt

SEQ ID NO: 699316 - DNA, 25 bp, Rattus norvegicus
ttttttctccccatgttggtgagta

SEQ ID NO: 699317 - DNA, 25 bp, Rattus norvegicus
ttttttctcccctgttgtcatcgtt

SEQ ID NO: 699318 - DNA, 25 bp, Rattus norvegicus
ttttttctccccttgttggtgagta

SEQ ID NO: 699319 - DNA, 25 bp, Rattus norvegicus
ttttttctcctcctcacaatatgct

SEQ ID NO: 699320 - DNA, 25 bp, Rattus norvegicus
ttttttctcctcgtcacaatatgct

SEQ ID NO: 699321 - DNA, 25 bp, Rattus norvegicus
ttttttctccttactatccactctg

SEQ ID NO: 699322 - DNA, 25 bp, Rattus norvegicus
ttttttctcctttctatccactctg

SEQ ID NO: 699323 - DNA, 25 bp, Rattus norvegicus
ttttttctctccaaaatgtgtgttg

SEQ ID NO: 699324 - DNA, 25 bp, Rattus norvegicus
ttttttctctcctaaatgtgtgttg

SEQ ID NO: 699325 - DNA, 25 bp, Rattus norvegicus
ttttttctctgaccttttccatcct

SEQ ID NO: 699326 - DNA, 25 bp, Rattus norvegicus
ttttttctctgagcttttccatcct

SEQ ID NO: 699327 - DNA, 25 bp, Rattus norvegicus
ttttttctcttcacaccatggagcc

SEQ ID NO: 699328 - DNA, 25 bp, Rattus norvegicus
ttttttctcttcatctagtacatat

SEQ ID NO: 699329 - DNA, 25 bp, Rattus norvegicus
ttttttctcttctcaccatggagcc

SEQ ID NO: 699330 - DNA, 25 bp, Rattus norvegicus
ttttttctcttcttctagtacatat

SEQ ID NO: 699331 - DNA, 25 bp, Rattus norvegicus
ttttttctgcacagctttccaaaat

SEQ ID NO: 699332 - DNA, 25 bp, Rattus norvegicus
ttttttctgcactgctttccaaaat

SEQ ID NO: 699333 - DNA, 25 bp, Rattus norvegicus
ttttttctgcctcattccacatttg

SEQ ID NO: 699334 - DNA, 25 bp, Rattus norvegicus
ttttttctgcctgattccacatttg

SEQ ID NO: 699335 - DNA, 25 bp, Rattus norvegicus
ttttttctgctactgtctgagttat

SEQ ID NO: 699336 - DNA, 25 bp, Rattus norvegicus
ttttttctgctagtgtctgagttat

SEQ ID NO: 699337 - DNA, 25 bp, Rattus norvegicus
ttttttctggatacattggtcttag

SEQ ID NO: 699338 - DNA, 25 bp, Rattus norvegicus
ttttttctggattcattggtcttag

SEQ ID NO: 699339 - DNA, 25 bp, Rattus norvegicus
ttttttctgggcaccgataatgaag

SEQ ID NO: 699340 - DNA, 25 bp, Rattus norvegicus
ttttttctgggctccgataatgaag

SEQ ID NO: 699341 - DNA, 25 bp, Rattus norvegicus
ttttttctgggtatcaccatcagga

SEQ ID NO: 699342 - DNA, 25 bp, Rattus norvegicus
ttttttctgggtttcaccatcagga

SEQ ID NO: 699343 - DNA, 25 bp, Rattus norvegicus
ttttttctggtcactgaccctgcaa

SEQ ID NO: 699344 - DNA, 25 bp, Rattus norvegicus
ttttttctggtctctgaccctgcaa

SEQ ID NO: 699345 - DNA, 25 bp, Rattus norvegicus
ttttttctggttactcagtgttgca

SEQ ID NO: 699346 - DNA, 25 bp, Rattus norvegicus
ttttttctggtttctcagtgttgca

SEQ ID NO: 699347 - DNA, 25 bp, Rattus norvegicus
ttttttctgtccctagcatgttcaa

SEQ ID NO: 699348 - DNA, 25 bp, Rattus norvegicus
ttttttctgtccgtagcatgttcaa

SEQ ID NO: 699349 - DNA, 25 bp, Rattus norvegicus
ttttttctgtctactgacccttgat

SEQ ID NO: 699350 - DNA, 25 bp, Rattus norvegicus
ttttttctgtcttctgacccttgat

SEQ ID NO: 699351 - DNA, 25 bp, Rattus norvegicus
ttttttctgttcaaagaggtcatat

SEQ ID NO: 699352 - DNA, 25 bp, Rattus norvegicus
ttttttctgttctaagaggtcatat

SEQ ID NO: 699353 - DNA, 25 bp, Rattus norvegicus
ttttttctgttgatcgctctgtgtg

SEQ ID NO: 699354 - DNA, 25 bp, Rattus norvegicus
ttttttctgttgttcgctctgtgtg

SEQ ID NO: 699355 - DNA, 25 bp, Rattus norvegicus
ttttttcttaaaacccactggcatt

SEQ ID NO: 699356 - DNA, 25 bp, Rattus norvegicus
ttttttcttaaatcccactggcatt

SEQ ID NO: 699357 - DNA, 25 bp, Rattus norvegicus
ttttttcttcacactgtttttgaga

SEQ ID NO: 699358 - DNA, 25 bp, Rattus norvegicus
ttttttcttcacaggcacttagcct

SEQ ID NO: 699359 - DNA, 25 bp, Rattus norvegicus
ttttttcttcactctgtttttgaga

SEQ ID NO: 699360 - DNA, 25 bp, Rattus norvegicus
ttttttcttcactggcacttagcct

SEQ ID NO: 699361 - DNA, 25 bp, Rattus norvegicus
ttttttcttcagagcttgttgtctt

SEQ ID NO: 699362 - DNA, 25 bp, Rattus norvegicus
ttttttcttcagtgcttgttgtctt

SEQ ID NO: 699363 - DNA, 25 bp, Rattus norvegicus
ttttttcttcatcttatcccaacac

SEQ ID NO: 699364 - DNA, 25 bp, Rattus norvegicus
ttttttcttcatgttatcccaacac

SEQ ID NO: 699365 - DNA, 25 bp, Rattus norvegicus
ttttttcttcctcacctgggatcaa

SEQ ID NO: 699366 - DNA, 25 bp, Rattus norvegicus
ttttttcttcctgacctgggatcaa

SEQ ID NO: 699367 - DNA, 25 bp, Rattus norvegicus
ttttttcttctcagacctcgtcccg

SEQ ID NO: 699368 - DNA, 25 bp, Rattus norvegicus
ttttttcttctctgacctcgtcccg

SEQ ID NO: 699369 - DNA, 25 bp, Rattus norvegicus
ttttttcttcttcaggcaaccatgt

SEQ ID NO: 699370 - DNA, 25 bp, Rattus norvegicus
ttttttcttcttctgtttctagaat

SEQ ID NO: 699371 - DNA, 25 bp, Rattus norvegicus
ttttttcttcttgaggcaaccatgt

SEQ ID NO: 699372 - DNA, 25 bp, Rattus norvegicus
ttttttcttcttgtgtttctagaat

SEQ ID NO: 699373 - DNA, 25 bp, Rattus norvegicus
ttttttcttgctaaggtcctgtgta

SEQ ID NO: 699374 - DNA, 25 bp, Rattus norvegicus
ttttttcttgcttaggtcctgtgta

SEQ ID NO: 699375 - DNA, 25 bp, Rattus norvegicus
ttttttcttggtactttgtggtgca

SEQ ID NO: 699376 - DNA, 25 bp, Rattus norvegicus
ttttttcttggttctttgtggtgca

SEQ ID NO: 699377 - DNA, 25 bp, Rattus norvegicus
ttttttcttgtgctgtgtattgcat

SEQ ID NO: 699378 - DNA, 25 bp, Rattus norvegicus
ttttttcttgtggtgtgtattgcat

SEQ ID NO: 699379 - DNA, 25 bp, Rattus norvegicus
ttttttctttcactggcaacctatc

SEQ ID NO: 699380 - DNA, 25 bp, Rattus norvegicus
ttttttctttcagtggcaacctatc

SEQ ID NO: 699381 - DNA, 25 bp, Rattus norvegicus
ttttttctttgtaagcagtttgcac

SEQ ID NO: 699382 - DNA, 25 bp, Rattus norvegicus
ttttttctttgtcatgttccccata

SEQ ID NO: 699383 - DNA, 25 bp, Rattus norvegicus
ttttttctttgtgatgttccccata

SEQ ID NO: 699384 - DNA, 25 bp, Rattus norvegicus
ttttttctttgttagcagtttgcac

SEQ ID NO: 699385 - DNA, 25 bp, Rattus norvegicus
ttttttcttttgcactactttctat

SEQ ID NO: 699386 - DNA, 25 bp, Rattus norvegicus
ttttttcttttggactactttctat

SEQ ID NO: 699387 - DNA, 25 bp, Rattus norvegicus
ttttttgaaacgcagagctttctgt

SEQ ID NO: 699388 - DNA, 25 bp, Rattus norvegicus
ttttttgaaacggagagctttctgt

SEQ ID NO: 699389 - DNA, 25 bp, Rattus norvegicus
ttttttgacattactcccatctttc

SEQ ID NO: 699390 - DNA, 25 bp, Rattus norvegicus
ttttttgacatttctcccatctttc

SEQ ID NO: 699391 - DNA, 25 bp, Rattus norvegicus
ttttttgatgatcgctctctcctca

SEQ ID NO: 699392 - DNA, 25 bp, Rattus norvegicus
ttttttgatgatggctctctcctca

SEQ ID NO: 699393 - DNA, 25 bp, Rattus norvegicus
ttttttgatgccactctgactgaag

SEQ ID NO: 699394 - DNA, 25 bp, Rattus norvegicus
ttttttgatgcctctctgactgaag

SEQ ID NO: 699395 - DNA, 25 bp, Rattus norvegicus
ttttttgattgcatacacacctccc

SEQ ID NO: 699396 - DNA, 25 bp, Rattus norvegicus
ttttttgattgcttacacacctccc

SEQ ID NO: 699397 - DNA, 25 bp, Rattus norvegicus
ttttttgcaactcagcctttcctga

SEQ ID NO: 699398 - DNA, 25 bp, Rattus norvegicus
ttttttgcaactgagcctttcctga

SEQ ID NO: 699399 - DNA, 25 bp, Rattus norvegicus
ttttttgcaagcctgactcgaaggg

SEQ ID NO: 699400 - DNA, 25 bp, Rattus norvegicus
ttttttgcaagcgtgactcgaaggg

SEQ ID NO: 699401 - DNA, 25 bp, Rattus norvegicus
ttttttgcacatacattgtttctgt

SEQ ID NO: 699402 - DNA, 25 bp, Rattus norvegicus
ttttttgcacattcattgtttctgt

SEQ ID NO: 699403 - DNA, 25 bp, Rattus norvegicus
ttttttgcagttcccttgtaaaatg

SEQ ID NO: 699404 - DNA, 25 bp, Rattus norvegicus
ttttttgcagttgccttgtaaaatg

SEQ ID NO: 699405 - DNA, 25 bp, Rattus norvegicus
ttttttgcatatctttcctttgttt

SEQ ID NO: 699406 - DNA, 25 bp, Rattus norvegicus
ttttttgcatatgtttcctttgttt

SEQ ID NO: 699407 - DNA, 25 bp, Rattus norvegicus
ttttttgcatcaagctttattgtac

SEQ ID NO: 699408 - DNA, 25 bp, Rattus norvegicus
ttttttgcatcatgctttattgtac

SEQ ID NO: 699409 - DNA, 25 bp, Rattus norvegicus
ttttttgccaaacgtgccaagtaat

SEQ ID NO: 699410 - DNA, 25 bp, Rattus norvegicus
ttttttgccaaaggtgccaagtaat

SEQ ID NO: 699411 - DNA, 25 bp, Rattus norvegicus
ttttttgcccctacccatgacactg

SEQ ID NO: 699412 - DNA, 25 bp, Rattus norvegicus
ttttttgccccttcccatgacactg

SEQ ID NO: 699413 - DNA, 25 bp, Rattus norvegicus
ttttttgccctcatttctgtagctt

SEQ ID NO: 699414 - DNA, 25 bp, Rattus norvegicus
ttttttgccctcttttctgtagctt

SEQ ID NO: 699415 - DNA, 25 bp, Rattus norvegicus
ttttttgccgccctggacatgttgg

SEQ ID NO: 699416 - DNA, 25 bp, Rattus norvegicus
ttttttgccgccgtggacatgttgg

SEQ ID NO: 699417 - DNA, 25 bp, Rattus norvegicus
ttttttgctccacttgaccggaggt

SEQ ID NO: 699418 - DNA, 25 bp, Rattus norvegicus
ttttttgctccagttgaccggaggt

SEQ ID NO: 699419 - DNA, 25 bp, Rattus norvegicus
ttttttgctcgtactatcagcttgc

SEQ ID NO: 699420 - DNA, 25 bp, Rattus norvegicus
ttttttgctcgttctatcagcttgc

SEQ ID NO: 699421 - DNA, 25 bp, Rattus norvegicus
ttttttgctgttacacccaccaata

SEQ ID NO: 699422 - DNA, 25 bp, Rattus norvegicus
ttttttgctgtttcacccaccaata

SEQ ID NO: 699423 - DNA, 25 bp, Rattus norvegicus
ttttttgcttccagagaactctcca

SEQ ID NO: 699424 - DNA, 25 bp, Rattus norvegicus
ttttttgcttccatgtgtcagcagt

SEQ ID NO: 699425 - DNA, 25 bp, Rattus norvegicus
ttttttgcttcctgagaactctcca

SEQ ID NO: 699426 - DNA, 25 bp, Rattus norvegicus
ttttttgcttccttgtgtcagcagt

SEQ ID NO: 699427 - DNA, 25 bp, Rattus norvegicus
ttttttgcttgcatctagtgttttg

SEQ ID NO: 699428 - DNA, 25 bp, Rattus norvegicus
ttttttgcttgcttctagtgttttg

SEQ ID NO: 699429 - DNA, 25 bp, Rattus norvegicus
ttttttggagtgcattgcaattttt

SEQ ID NO: 699430 - DNA, 25 bp, Rattus norvegicus
ttttttggagtggattgcaattttt

SEQ ID NO: 699431 - DNA, 25 bp, Rattus norvegicus
ttttttggatcacctggcagagact

SEQ ID NO: 699432 - DNA, 25 bp, Rattus norvegicus
ttttttggatcagctggcagagact

SEQ ID NO: 699433 - DNA, 25 bp, Rattus norvegicus
ttttttggcctcatcagtctgtaca

SEQ ID NO: 699434 - DNA, 25 bp, Rattus norvegicus
ttttttggcctcttcagtctgtaca

SEQ ID NO: 699435 - DNA, 25 bp, Rattus norvegicus
ttttttggcttaccatctcttctgt

SEQ ID NO: 699436 - DNA, 25 bp, Rattus norvegicus
ttttttggcttagcatctcttctgt

SEQ ID NO: 699437 - DNA, 25 bp, Rattus norvegicus
ttttttgggctacgcatcacttctg

SEQ ID NO: 699438 - DNA, 25 bp, Rattus norvegicus
ttttttgggctaggcatcacttctg

SEQ ID NO: 699439 - DNA, 25 bp, Rattus norvegicus
ttttttggtgtgatgtacagcagta

SEQ ID NO: 699440 - DNA, 25 bp, Rattus norvegicus
ttttttggtgtgttgtacagcagta

SEQ ID NO: 699441 - DNA, 25 bp, Rattus norvegicus
ttttttgtacacctgcagagactca

SEQ ID NO: 699442 - DNA, 25 bp, Rattus norvegicus
ttttttgtacacgtgcagagactca

SEQ ID NO: 699443 - DNA, 25 bp, Rattus norvegicus
ttttttgtagtgagtctgggcgcat

SEQ ID NO: 699444 - DNA, 25 bp, Rattus norvegicus
ttttttgtagtgtgtctgggcgcat

SEQ ID NO: 699445 - DNA, 25 bp, Rattus norvegicus
ttttttgtatttcgtttgtctatat

SEQ ID NO: 699446 - DNA, 25 bp, Rattus norvegicus
ttttttgtatttggtttgtctatat

SEQ ID NO: 699447 - DNA, 25 bp, Rattus norvegicus
ttttttgtcacgatcctcatgatat

SEQ ID NO: 699448 - DNA, 25 bp, Rattus norvegicus
ttttttgtcacgttcctcatgatat

SEQ ID NO: 699449 - DNA, 25 bp, Rattus norvegicus
ttttttgtcatcaccttcctgggat

SEQ ID NO: 699450 - DNA, 25 bp, Rattus norvegicus
ttttttgtcatctccttcctgggat

SEQ ID NO: 699451 - DNA, 25 bp, Rattus norvegicus
ttttttgtcattcctctgtttttgt

SEQ ID NO: 699452 - DNA, 25 bp, Rattus norvegicus
ttttttgtcattgctctgtttttgt

SEQ ID NO: 699453 - DNA, 25 bp, Rattus norvegicus
ttttttgtgacgacctttcttacat

SEQ ID NO: 699454 - DNA, 25 bp, Rattus norvegicus
ttttttgtgacgtcctttcttacat

SEQ ID NO: 699455 - DNA, 25 bp, Rattus norvegicus
ttttttgtgcagatctcattgcaaa

SEQ ID NO: 699456 - DNA, 25 bp, Rattus norvegicus
ttttttgtgcagttctcattgcaaa

SEQ ID NO: 699457 - DNA, 25 bp, Rattus norvegicus
ttttttgtggccagttcttcccaat

SEQ ID NO: 699458 - DNA, 25 bp, Rattus norvegicus
ttttttgtggcctgttcttcccaat

SEQ ID NO: 699459 - DNA, 25 bp, Rattus norvegicus
ttttttgtgttcaccctttcagtgg

SEQ ID NO: 699460 - DNA, 25 bp, Rattus norvegicus
ttttttgtgttctccctttcagtgg

SEQ ID NO: 699461 - DNA, 25 bp, Rattus norvegicus
ttttttgttctcactcattttttag

SEQ ID NO: 699462 - DNA, 25 bp, Rattus norvegicus
ttttttgttctcagaccacttctct

SEQ ID NO: 699463 - DNA, 25 bp, Rattus norvegicus
ttttttgttctctctcattttttag

SEQ ID NO: 699464 - DNA, 25 bp, Rattus norvegicus
ttttttgttctctgaccacttctct

SEQ ID NO: 699465 - DNA, 25 bp, Rattus norvegicus
ttttttgttggcacctgagtcctcc

SEQ ID NO: 699466 - DNA, 25 bp, Rattus norvegicus
ttttttgttggctcctgagtcctcc
